United States Patent 10,233,495 (METHODS AND COMPOSITIONS FOR SCREENING AND TREATING DEVELOPMENTAL DISORDERS) - sequence listing, part 30

SEQ ID NO: 270 - DNA, 800105 bp, Homo sapiens
  misc_feature (411054)..(461053): n is a, c, g, or t
ttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgtaaaaagaaaaaaaaaaagttagaaaaagagatatgccaaaaagaagaaagtaaaaaatacatgacttctgtcttctgttaacatattaaaatttatgcttttagatttttatgtgtctatatacatgtaaaatatatatgcatccccaaattgtattatactcttttgagacctcacatttttttcacccaagaatataatattaatttctttcctttagaaaagacatgagactaaagaatgtttattgagttgagagtttcccaatcaaggagtatgactctgtataataataaatctaatgttttattagaaattataataaaattagaaatttaatatttggcaggatgtgagttgcctgcatatgtacaccctttattatatgactagacactcttttgtgtggtcatggatatattggcatcttttgaagtgtatcctttttgtttcaggagcttctgtctagatgaatagcaagtgtgacactgataatagtaatcgaatattcctccaagtacaggctccttcctctttctcctggacctttgcacatgctgcctggaaaactcacccacaacctactttccatcctctccttcggctcatccctgctcagccctctttgttgagatatttgccaagccagattctctgagaagcctttcctggcatcttcgtctatataattctgctagttgtttctaaaactatgttgttagtgtatattgtaatcacctatttatgtctgtttgactgtgagcctcttggagatgggaattctctcctatgcattgcggtttccccagcccctagcacactgtctagcccagtattccttctcagtaagtaggtgttgaatgacttacaaaatgaatgctaaaagacctggtagacaagaaggaatttcttagcctaaatgaccagatgtggagaagatactcaaacacttcagggtccccaatctggtgatgtcacttgcagtggaatttcatatgaatccagtgtgacagaagttgcctagtcaagttgtaagtcctcttctctgggtcacatgttcaaatacttttaggggacagataatgcaatatttaagatacaggaagtgatgaggactgtggcacactggagagtttggactccaagagtaattaattcagttgaaaaaatcaacagcactctgttgatcaagcaaactttctaagggccctaatccacctgggcctgcagtatgtaattccataactcatgggatgccatcaagagagacaatctacttgattgttaaagggcctttgttttctttggagttccccaggaaggagaaatgtatgtgtgtgcaggggtgaggagggggggagagtgaagaaacaatactatccccttaaaaagttttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatatattcaaaatactgattttttaaaagtatgttccttggagccctgggaacctgcctcaggagctgaggtggctgtggggagggagtatgaagggagctgaatgagtgagaatctgggtcttcatatcttttttaaaattgtggctgcttttttctgttatgtataacaactctttttgaaaacagtttcattttgagttttaaaaccactgacctaaaataaccaccaatttaacgtaagtataacttcattgagtttttttgtattaaaaaaattaaactccattttcttcatggattaaggtgatcctactaggatatttattaagcattgtctctgctgttctttttgcttgccttgctttatcccgtgtttccaaaaaatacaaataggtattttgtcagctattttacattttatagcagggaaaacagaggcttgggtgatttaagtaagttacagttagtaagagccataggatacatttcggtgtaagtcaatgtttatgtaaggcttaagagacattggttgaattggcatgactagaatagttgagaatgtttgggaatggggagagattgctaatgggatgtctgccaggggcaatactgaaaatctactggttggcaaaggtagtgcctgagcccagtgctaaccatagtagttggaaaattgtgtacgttggctgtggaatccttatgcaaatatttgtccaatccatctaaatttctctctgcagcatttttaaaaagacatatagctgaaattttgtcagtcctaaaaatattttgtatttctctgcccagatttgcatttgggtagatcgtgctgtagaagatatatcttgctttgagatagctgccactgaatagtttagtctattttaatcaacttattgccttgtaatctttcctttttcattctctaaatttctgaaattctatctttcatgttccccaggaaagactagtaagacgtgtttttattaataagacattatcctcatttcaccacgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggtatggggattgcagtttcagatttcacctcaagtcttcctcttctggttcctgaagctccggcaacctctgctttgaaacattgttggcctcttcatcccatcccatgtcaatatttagcccatgccctgttggctttgacttagctcaatcaccttaacccagtgtcttaaaattcttgattttgagtttctcatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccactccccacccactcatcagcagtttgtattaatttagtgtaaagctgtgtaaagtttattgattgataacatctgtgtcaagatcatggtttttattataaagagcagttcattgtgttttttccttgcccacgaatggtatctctgttcattaggatacataatattttatgcgtaggaggatagtgtgagaatatgagtagaacaaagtaagaatgagaggagagaatagtgaaatttgaggataggatgagaatgtgaatagatttatgtccatccattacaagattaataaccacaacgataaaagtcttgaatgttatttatttgcatatgagtgatatttcagtttgtggctgatacccttttggtattaaatggaagatgacaaatcattcaatattaattttagagggagacatctattgaaacctttgtgcagtcaggtcaagtttctgtgtacaaaaattagcagagaggttgctgctggttgacctcccctaggatggtgtctttctgaacattttgaaatgtagattgaaaaggtggatttgtcaactaactctgaagtgctgtagttatttgtgttttcatcgttttattgtttattttatttttaaggtggagttttcgctcttgttgcccaggctggagtgcagttggtgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccaggaaaaaaaaaaattgtgaagcacagagctgcttaaaagagtgatgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccagactgtttaattagatgttagatttgtagccaaatatgtctaggaaatgcttaaacaatataaaacagttttaatgattggctttttagaacgttatatattagtgtgctttatgcgtatccaagaggtgagtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggttaactggcatttggcatttcacaccactaaattttctacatgtggatttatttctctggttctctcactttctcactcagttatactgaattcatttatgatgagcgctctcaaccattcttattcatcaaagccctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaatgagagtatctatttggtgaaatcattttcctccatgtgaccaaatgagaaatttagtgaaagatttaaaatcatttttcagactttttccacattagtcgggaagcaaaccccttttttaaggcaatgtcagttattaagctttagggaaccacatgccactttaggtaacacgtgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaaaaagttagtccctccagctgaaaagcggtcattactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttcatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaagcaaagactttttcaacatctgaatattctgatttacagaaatttaaaaaaaaaacccccgaacattacacgggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaataatatctatgtctctcttcctactacatactatctctctatgtatatgcaattgctataaacatatcttcatatttgatatatataggtacatatatatggatagataaatatagatatatgagagagaaatggagattagagatctatgtttgccataaatcatacttgttaacataaaccatctgattaaactgatattttgtggcccaagacctgagacatgcaaaactattcttagcagatagaattttctaaaagctgagagctcattctccaggagctggccaaggaccagtcctaaaggcagacctttcttggaaatgtacagagtctgggcaaacaagacctgctgagttaaccctttcctatacatatgcagacggtattcagcacagggcctgacagaaggcagtgtttgttattattattcatagcattagcccatttcttgttgtgagcaacatgaacaaggagactaaggggaaaaaatgcccttttttagggtgaccaccctaactgatttgaaagtctacaattttttcagtttaaaatggtatttatttgtaacatgtactattgttgaataacaatttctaataaaaaaactacgctagttttctgcctatggagaagccacctttttattcttttactttcttaataagcttgctttcacttaaaaaaaaatctaccctacatatacacaaaagttaaaaagcagcaatagtgtacattggtcagtataaatgcatgcagttttcttttcttcagtgtacaaagtccaagtctaaacctttataatttttagagtctagcgattctccagactccatacttttcgttgttatcagatgccagcgttaattgcttttcctttcttctgttttgggttcctgatcttcatctgtgtctttaaaacagattattttctttagatttgaaaggttgggtttttgtcttcatatcttatttgtttagccttgtatttccctttctttaattgaattgtgttattgaaaattaaataatttatctgtgaagtcaaaaatcctgtttcagggtgggctctagagccttcctcttgggccatatccttagaaagcctgtgtgtattctgatacatttggcaatttctactggcttttcttgtgttgtctgacccctttttatttcagcggtgcatcctggtcttacccaacaggcaagtggtgactccagtgcaggtgacgcagaggtgacactagaatgaagtgaaatattctgttgagggctaagttcatgtttttgctgacagtggtggataaatgtcatggcttccccctgcatagtgcttaggacatttcttttgatatgtgttttagagaaaacataaaacttgtaatcaggaaaatgcaataacggaagaaatgcttacttgagtaactaatgtgagttaggcaaagaagatacaaatacttcccatttcctacttctaaattacagtcaaattgtcctaagcaaatctctcattgtctccatgtaaaagatatagagaagccattagaaaaaggtggctggaacaactttatacatacagcctgaatgaactgcctcatcatttatatgtttgaggaaagtgtctgtttgataatttaaattaagtttaaactgtcataaacggagagctgtacagattctgtgggagaggatactgaggtaccagatactcattactaggctctccactctgccttcttcaatactctggatcggtgccctttattcatttttttcacaacttcctcccctttgctcacattctttacaagcttccaggattttttaattttattttatttctttccacaatgactctcatggctgttgctatagttgctataaaaggcaaggtggggaacagacaggtgaatgagcacagaggtcatttgtaaaccgtttgtggttagtgctcctctgtttactgtctgtctctctaagtgtctctgggtatgtgtctgtttacaacataaaatatatgcacacaaatctccaatttttctagagtaactattaacacagttaaaatctggaagaactctatcttttaaaggaaataccaattagcaaataaaagagttgattccccccaactctcattccccagagcttgcttaagtgtatggtttgcacacattccctaaataaaaacattgctggctcataactatgcttcactttcataagccttccaaatgttagtaacttagccttctccttttgaagggttagtctgtaagtgatactggaagccatgtggtaagaaagaggacagaagtataaaatcagactcagaaagtaaaatctggcatatttggcatagatccattcagcttcgtatactttgttaggacccgagggcatgcctgattttcataaaatcgatgcactcttattaaaacaaacaggtgaaaatcacttttgttaaactacttgacaaggcatctgactaccttaagtgtgttataaattttgcaagtggttaaaattttatgcttatgaattcaaaagatagactttagttaaattaaaaactaatttatgtagatattttccctaataatatagcacaaatgggttttatttccaactgaaaagagtgtttattaccatggatataactagaagaatcatacaaatatatgtaattccattagaaaatatttttgttaaaatttgaaatgacaagaacttaatgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactattatttcatatcctttgacttacaggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaactaacattttgccaagctaaattttaatgaatttatttggacgtttttataatcacttaatattttcagttcatgtgctaatattaactctacttactggagagaaagaaatggtattcaatatgataactgccttgttactgcagaaatgtagaagtttggcattttaagtatcaaatattttaagtcaaaaaattaccagtgtcccacagcacagagagagaatatatgtttgcttgtgtccctttaatctttcccctgtaaaattaagcctaggggccttacactattttaaattttcaaaattaggtcatgtaaatgttgtgtcagatttccaattcataagtagtatacttatgaatactgaatagtgaacatagggtacatttatatcctgctgattgcttagctgtggaccagaggtaaacagagaatgaatggtattttcacaggttagtaaactgtttttctatgatctcttatatacaagtgtgattaacattttttcccccttcctgaactaatataggaacatatggtctaataagtgtgagttcatttggggagggcaggatagaatgcttgaaattaggactgacccaaaaaatgccttggtctcagtatttgtggattacgaggaggaagggctgaaaaggaaccttaaaagcattagaatggtagagtacagattagcagcaacactcagggctccatcatgaagagagtgagatgagttcccatggttaatgcagcaggggctctaattgaaagccctctacctaggaaatgatttaaatccttttatcctagctggattgtgaacattttatttactttgaggaagttgtttaacactttttgtagattgcatcaatatttagagtaatgtaaatacattttccctttggctattttacaaggacattgagaattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatctgcagtttttttaaccaagaataaacacaagttctaatagcaaacagaaataaactccctacacattaccttctccattaaaatatgttttatgccacatgcagaattttaatattatatagttatttgtgaaagtataactaaatagaaattttaagaaagaatgcctctaatattcatatcttagcactaaagaggcatatattattctgcagattgaattaaaatgttagttaccaagatatgaacttagacattttcagtaagcatttataggctattctagtggaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagtgaaagtagataaattcatattgtatgtctgattctctttgggtttgaaaagaaataaagactctacttctaaattagcatagaaaaaaggagaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttttatatatattcatatattctcttcaacatacataatgtcataaaaaggataaaacgcctaagtctagtcttgacagagcaccagcttaaatcacatgcgcctatcagagaacttatgacaatatttagggctaaacttatgttactggtgaaccagtatctggaatgatttccataactcacttaacttgcacatttataatgtggactttaaagaataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacagtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattccaaccggtgtgagatggtatctcattgtggttatgatttgcatttctctgatggccagtgatgatgagcattttttcatgtgttttttggctgcataaatgtcttcttttgtgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcatcattctcagtaaactatcgcaagaacaaaaaaccaaacaccacatattctcactcataggtgggaattgaacaatgagatcacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaaagcaattgcttgagactacttcactgtaagctcctttttttttttttaaataaatgcagattttatgatattcctgatcattctctttgcacttagttttaaaatgttatttgcagttgattagagagtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgaggacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatattttttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaaacccatttctaccaaaaaaaaaaaaaaaaaaaaaaaaaaaaaaaaaaaaaaaaaattagccaggcatggtagtgagcacctgtggcccagctactcaggaggctgaggtgggaggattacttgagcctgggaggtgaaggttgcagtgacccaagcttgcaacactgcatttcagcctgggtgacagaggaatgggccttcactagacactgaacctgctggcaacttgatcttagactgaccatcctccataactgtgagcaataaatttttgtggtttataagttactcactctgtggtattttgttatagcagcacaactggattaagacattaacctgaccttaagaaatcatctcaaatcagtcttggctttgatgagaaacaaagggcacactcgaatgtgtgatttaaagagaggttttttttctcttttgagatggagtctcgctctgtcccccaggctggagtgcagtggcatgatctcggctcactgcaagctccgactcctgggttcacgccattctcctgcctcagcctctggagtagctgggactacaggtgcccgccaccacacctggctaattttttgtatttttagtagagacggggtttcactgtgttggccaggatggtctcgatctcttgacctcatgatctgcccgcctcggcctcccaaagtgctgggattgcaggcatgagccactgcacccagcctacagagagttttatgaagagaatatttctaaatatatggacaggatcaaaataacccaacaaaggactgagaggcgctcagaatctggaatcagcagagaagttgtattgcctctaggacttaattgttgtataagtctgttcaggttgccataacaaaataccatataccaagtggcttaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcatgaggaccccactctcataacctcttttaaacctgattacctctcaaaggccccagctgcataaaccatcacactgggggttagggcttcaacatttaagtgtgggagttggtgttcacaattcagtcaattggagtggaaattgaaatgggaaaggaaagctatagttactagagagagctattgtcttggggaggatcactggacaggactatggtctttggagaaataagcgagttacaactgacaaagattctttctgtgaaaataagtaatttaaaatgtaagttgttggaattccaaattactgtgagccttaaaaaaatgtgagtatgggccaggcaccatggctcacacctgtaatcccagtactttgggaggcccaaggcaggcagatcacctgagatcaggagttcgagaccagcctgactaacatggagaaagcccatccctactaaaaatacaaaattaaccaggtgtggtggcgcatgcctgtaatcccagctacttgggaggctgaggcaggagaatcacttgaacctgggaggcagaggttgcagtgagctgagattgcaccattgcactccagcctgggcaacaagagtaaaactctgtctcaaaaaaaaaaaaaaaaagaagaaaatgtgagtatggagcctaagtcacatgagaggcacctgtaaactaggcagttgtaacctttgtttctctgattatagattggccttcttccttacatacattgttgggttttttttgtttgtttgtttgttttttttgagatggagtcttgctctgtgggccaggctggagtgcagtggcatgatctcggctcactgcaaccttggcctcctgggttcatgccattctcctgcctcagcctcccgagtagctgggactataggcgcacaccatcacgcccaggtaattttttgtattttagtagagatggggtttcaccatgttagccaggatggtctccatctcctgacctcatgatccacctgcctcagcctcccaaagtgctgggattacaggcatgagccactgcacccagccacacgcattgttttctaacatgttatacaaattattgaagggtgccagggaagattgcttccctctgcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtgaaatcccatctctagtaaaaatacaaaaaattacctgggcatggtggtgggcacctgtaatctcagatattcaggaggctgagacaggagaatcacttgaaaccaagaggcagaggttgcagtgagccaagatcatgccattgcactccagccttagcaacagagtgagactccatctcagaacaacaacaataacaaaaaaaaaaaaaaaaaaaaaattctgcaactaattaatttgttgtaactcttaaagcagccttatatagaaaatgttgtgatcctattaattttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacgctgaattctgaacctttcatttatttcaggttgacatctccttggccaaactaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcaccccaaaaagggactctttcctgtttattattgcaaagccaatgtatgaaaccaagagtgagcgtcaagcagtgcaggctctattcaatggcactggagaagtaggagcatagcatggaattggagaagtagtatagcttgcaaatcaccttctcagctactgagaaccaggaagttacaaatatagaggatctttaatgaagggaatgagcaaggtgaggaatattcatgcttttcttagtaagggatggagattttcctagaatcaaggagtcacctcatttctgtcctttcttggtctcttccgttcattgtcacagtgattgtcaactgtcatgcactgatgggagtgctatttagcatggaaattggattataataaagctagatgtttttcagaggttgcgtaagctgccatcatggatttcaccagcttcagctggtttagtcccaagaagaaacttctgaccacagacatcctgtttcttaaaaataagcagagttaaaggtgagtaagaattcagccatgtcacataggcactgcaatggccaacaacatctgggtaggggtccaggtaagtcatgtaggcagtgcaataggcaacacagtcacagaaatacctatgaaaagctgtccttttgtcagggagattagcatgtgtagaggaagtacacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattacttatttatttatttattttagacagagtcttgctctttcgcccaggctggagtgcagtggtgccatctcagctcactgcaaactctgcctcccaggttcatgccattctcctgcctcagcctccctagtagctgggactacaggtgcccgccaccacgcctggctaatttttttgtatttttagtagagacggggtttcactgtgttagccaggatggtcttgatctcttgacctcatgatccacctgccttggcctcccaaagtgctgggattacaggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctgcttcttgagagacttcatctgcatcacatctgcatcacaacacagcctttgctcaccatgtctttcctcccctcaacctcccataacctgtggccaccaccccctaagaactccaagcctagttagtcctttatgtgctgcatataaacttcaaccatacggccttctttgaggcttttttttttttttgagacagagttttgcttttgttgcccaggctggagtgcaatggcatgatctcagctcaccgcaacctctgcctgccaggttcaagtgattctcctgcctcagtcttcggagtagctgggattacaggcatgtgccaccatacctggttaattgtgtatttttagtagagacggggtttctccatgttggtcaggctggtctcgaactcctaacctcaggtgatcaggatccacccgctttggcctcccaaagtgctgggattacaggcgtgacccactgtgcctggcctgaggctcatatttttatgtgactctgtattagtcagggttctctagagagacagaattaataggatagatatacaaaggagtttattaagtattacacttacttttttttgtctttttttttcttactttttgtggaaaacagggtcttgctatattgcccaggcaggtctccaactcctgggctcaagctatcctcccgcctctgcatctctgagagctgggattacaggtgtgaaccaccacacccagccaggagtttattaagtattaacttacacaatcacaatgtcccgcaataggctgcctgcaagcttaaggagcaggaaagtcagttcaagtctcaaaactgaagaacttggagtctgatgttccagggcaggaagcatccagcacaggagaaagatgtaggctggcaggataggccagtcttgccttttcatgtttttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacccgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggcccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagagagggtacaattatctatgttgcaagctagcttaaactaaatttctttgtggagtggggaaggggtagatgagggggcccccaccaatagatgcctggccactgggtgaaagggaaagaaggaaggtggagggggtggctcagtacattctgcttctttatttctttctttccaggtaggctgcctaaacctataccaagccacttagaattgaaaacagataatcacatataggttatttcctacaattccctcctttttctttttaccctttttggtttcattttcacttaaattgctttttcaaactgttccagaattgtttacttttttttttttttagacggagttttgctctgttgcccaggctgcagtgcagtggggtgatctcggctcactgcaacctctgccccccaggttcaagtgattctcctgcctcagcctcccgagtagctgggattataggcgcgctgtaatttttgtatttttaatagagacggggtttcaccatgtttgccaggctggtcttgaactcctaaactcaggtgatcatgagcacccgcttcagcctcccaaagtgctgggattacaggcgtgagccaccacgccaagccagaagttgtttactttcttcctcataggaggaggagtttatttggtttctaataatagtaggttattttgttggaacatcaggggcatctgtttactgagagttgttttaataaaccttagtgttatatatatatatacatatatatatataatatattacatatattatatatagtagtagtgttaaaccccttacacaagtattgatgcaacatcgtatgtcaatgacagaatctgataagttggaagagtatactgtagaagatacatcacttttttttttgttttgttttgagatggagtcttgctctgttgcccaggctggagtgcagtggcgcaatctcggctcactgcaaccaccgcctcctgcattcaagcaattctgctgcctcagcctcccaaatagctgggattacaggtgcccaccaccacacctggctaatttttgtatttttagtagagacagggtttcaccatgttggccaggctgaacttgaactcctaacctcaggtgaactgcccgccttggcctcccaaagtgctgggattataggcatgagccaccaccctgactcatacttcactattgaaacaaactttttttgtgtacagaagaaaaaaaattgtacagttaatagtgtcagagatagtgaaaatatgaaacaagaactgcttacaagaaaggagcactcaggggaccaaacctctgccagagccagcggggaagtgacttatgcctctctcttctttccctcctgtccccccccctcgtctcccgcaatgaagcgggtacttaatctgtgtcctgtggaggtcccctttggcagccagctggaagcccgtgcaccctccttcaaataatggctttcaatgagcagactagaacgtttaggattgcaaaggaaaccgattcctttcaaacctggttatctttgtgatgtggcactgtgtgcatatcttcgttaaaatgcattgaaggccactgcactccaccctgggcgacaagaggtgactgtgtctcaaaaaaaccaaaaacactcccccctcaccccaaagcattagacatcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcatatggaccttggacatctatcttcctgaacttttctctcctgtttttacattcttattttggtttgtgggaaatattcttgatattatcttcaacttaatttttgttcttgcttctactattttagtttaatttccaagtattttgatattgaactttcaagagaacagacatccctgccagccttgacgtctaatgctttggggtgaggggggagtgtttttggttttttcgagacacagtcacctcctgtcgcccagggtggagtgcagtggccttcaatgcgttttaacgaagatatgcacacagtgccacatcacaaagataaccaagtttgaaaggaatcggtttcctttgtaatcctaaacgttctagtctgctcattgaaagccattatttgaagaagggtgcacgggcttccagctggccgccaaatgggacttccacaggacacagattaaatacccgcttcattgcgggagacgaggggcggggacaggagagaaagaagggacaggcataagtcacttcccccgccggctccgacagcgggttgctccactgaggggcgttgggtgaggcggaagagcagacggggatccagaaggcgttgtcggtgacatcacggaaagggcgatttctatgtagatgaggcagcgcaggggctgctgcttcgccacctgctgcttcgccacgaaagagttcccgtgccgtgggagcaagtctgggacctctggtcggaccggagagtcgcagctgtgtgttagggctaggatggctcctggatgcgcgtgacgcaagtgaccttgcgtgtaaagggtgaggcatatgaggctgcggcggggcggaggggcgtgagcttatacttatgtttatctggcagaagaaatgttatgatcacgaaggtggtttttccagagcaaggcttagcagttttactgtggatgtgctgacccctgtgatttccccgaatgtgggaatcttgattacataatttgtggcagtggggaactgtgtctgtgttttcccctgggttgttgtcgttttaaaagtggattttgtttgctgtggaagcatatacaaggcgttagtataaactaataaacaggtctttgttcccatctgtaacttactttcaaagtaaagattttgccaggtagtggttggttctcacgcttgtaatctcagtagtctgtgagatgcattgataactttatgttaataccgctcgagctctggaatttgatgtcagtgtggtcaaataaggtggacccgtctctactaatctcttaacttttttttttgttctatagaaataaaactaagcttttcttttccctacgggagcccattgtaaacatttattaacagcaaacagtccactggagtgcatggcgggatcccggcttactgcaacctctgcctcctgccttcaagctattctcctgcctcagccagagaatactcgatctcctaagtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaaatgtcttttttttttttttttcccagtgtggcccaaggaacccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtaacaaaacccagctgggatcctgcaacttctaaccttaatgttagatcaagaagcaaaacacccaccagtccaagggtcagggaagatgaagatcatgcctgagctgtaacaacgcccttcccagtatacaaaagcgtgtaacagccacttgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttctcttttcctcctcttcctcatcctcttctttctcttcttcttcctcctttttcctccttgtaaagccatacttaaggttcaaataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaactattaatgaatatgatagcgaggatgatggaagatgagaattctcaagaaaagtattggttaatatataaccaaatgtattcatctcaaaataatgaagaaatactcctaactattacaagtcctcatttctgcaactgtcactggccctagctggtatttgtaactatcttcacatcttgctctcacagccatttcctttgggcctgggccagtggacgtgagcgtgggaaagaccagaacccgcggtgccccccaccgcactatcctcgggtctccagaggtgggatacaccgggcaggggcctttgctggattctaaaccggctctggggatacaagaacagctgcctttgagaaacagttcaagtctctatattccagacttcctagtaggactaaatgcttaatgttcacccaggaattcatggttctcctaaaaccctgcggtggaatgccttccttcaccgagcatttattgggcacctactaggtgctagggtggctctgggtgaagggctgcagcctgtgcaaactccaggtccctttcctgtggatcccacctctgagggcccgagggggacgcagtgaggacaccacgggttctggtccttcccacgcgcgcgtccgctggcccaggcctggcggaaatgactgtgagcgcaaggtgtgagcggggctaagaatgggaaagcgagtgactttcgccggagaagctgcagttgtcacctgtagaggggccggcgacttttgagacggtgaagagcaggcgggggaagcagtgaagagcagacggtgaggagcaggtggccctttggccgttggagtcccccagctgactctgcccgggtagaacgtccaaagtgcccaaagactcgactcttggcttcattgtctcccgtattctgggtttctggagtgcgcgggattggacaggcatcaaatatatgagattatctgcagccagaggttaaaaagccatttctggtatcagcaaatgagtttaagacacaagccattagagtctctgtggcgcaatcggttagcgcgtttgactgttaactgaaaggttggtggtgcaagcccatccagggatggcaccttttgcttaggcaagattcacagtttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacgccagagccactgcacctatttcatcacctcctgaagctgggtttttacaattgcacattcctggaaatccaaaactcccaataattgaaaacaagaaaaccccagtcttcacttgtagtgaagcctcaatttctgggttgaaatcttggttcattcatgacgtgacttttaaaacgttactggattttctgtacctcaatttcttcgtctataaaaaagagcagccgggcacggtggctcacgcctgtaatcccagcactttgagaggcccaggcaggtggatcacctgaggtcaggagttcgagaccagcctggccagcgtggtgaaactccgtctttaataaaaatataaaaattattcaggcatggtggcgggcgcctgtactcccagctacttgggaagctgaggcaggagaatcacttgaacccgggaggcagaggttgcagtgagccgagatcacgccattgcactccagcctgggcaaaagaacgagactccttctcaaaaaataaaaataaataaaaaataaaaaagaaagaaagaaagaaatttttcctggcacatttctatatgttccattctggatgacttgctcttcaggcttatcccacagctgttatcataatatctctctttactacaccatcttgggatttccatcacctctctcttgttagatcccctgcttcatggatctcaagggggttcattcctcactcacttcttccttttgatgatgcatatcctccaaaacctcctataaagtggttaccttagaaataaactttttgagacactgcatgtctgaaaatgtcttttatacccataaaattaattgatattttactagatagagatacaaaaagataggtggaaataatttctctctgagatttttgaaggcactgctttttttgtgtgtgacagagtctcacctcgctctgtcgcccaggctggagtgcggtggtgggatcttggctcactgcaatctccacctcccaggttcaagcgattctcctgcctcagcctccccagtagctgggactacaggtgcctgccaccatgtctggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccagtacatgcagcccccagtcacataccccttgcttgctcagttgatcatgaccactccaacacagcccctttagagttgtgggcccttaaaagggacaagaattacttatttggggagctcagtttctaggatgtgagtctaccgatggtcccagctgaaaaaagctcttacattccacaatcgggtgtctgagggattttgtctatgactcctgctacagtttcaaactcctgacctcaagtgatccgcctcccttggctttgcaaagtgctgggattacaggcctgagccatggctcccggcccttgttgtttactgttttccatagtcatttctgagaaagaaaaaggtaagccttttctgctctgagctagagctggtctgacaaacacctaggccatggtgttctatggttaaaatgaaaaatttcacaacaccaatatcagacaaagttaccctctcactaaactgaaagaaatactatttcacaatcatatttgagcataaaaagaacactgttcaaaccataatatgatcaaacatcccagctactaatagtgacagttaatgattttattttttatttttttgtgatggagtcttgctctgtcaccaggcttgagtgcagtggcacaatctcagctcactgcaacctctgcctcctgggttcaagcaattctcctgcctcaaccttccgagtagctgagactacaggcacctgccaccacacccagctaatttttgtatttttagtagagactgggtttcaccgtattggccaggctggtctggaactcctgaccttgtgatccacccccgccccgctcagcttcccaaagtgttgggattataggcgtgagccactgcaccaggccagttttttttttgttttttttttttgagacagtctctgttgcccaggctggagtgcagggacgtcatctcagctcactgcaacctccacctcctgcgttcaagtgattctcttccctcagcctctcaagtagctgggattacaggcatgcccaaccatacttggctaacttttgtattgactgttgattctttaccaattatgtgtttagtcttgcaaccacttctcccactttctagataaaaataccgagattcccaaaggaagaattgccccacaatttccccatagtgtttgctgtctcctgtgttgcaatgagccaatatactcaggtttgactataggtttgttcctgatgattatacactggagcacatcagcaccatagagaagatggatgccgttctgattctttgttatttgccttaaactcttctcccatctcccctcccaaaagcctatagaatcttctacctcttcctattagtttgaaacttcatgatctatttccatccaccatgctgggtactgagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaataacaataattggctgggcgtggtggctcacacctgtaatcccagcactttgggaggccaaggcgggcaggtcacgaggtcaggagattgagacgatcctggctaacacggtgaaaccccgtctctactaaaaatacaaaaattagccaggcgtggtggcaggcgcctgtagtcccagctactagggaggctgaggcaggagaatggcatgaacccgggaggccgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctggttcatttggggctggatggtctaggatggcctcacacatctggggtataggtggattggttggaaaaagtgggatgcatggatctttttcttcatgtgatctctctagcaagctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatagccaatccaagattcaaagagaggagaaatagactctcttgatgagagaagctgcaaaatataaccactttttttttcaatctgtcacagtataccatactggactatcagtagcttcctcatttttctttctttctttctttctttttttctttctgagacggagtcttgctctgtcgcccaggctggagtgcagtggcgacatctcggctcactacaagctctgcttcccgggtttagccattgtcctgcctcagcctccctagtagctgggactacaggcacccgccaccacgcccggctaattttttgtatttttagtagagacggggtttcaccgtgttagccaggatgatctggatctcctgacctcatgatctgcctgcctcggcctcccaaagtgctgggattacaggcgtgagccaccgcgcccggccatgacacaagtttaaaagaatatttttgtttgtttgtttcagacgagtctcgctcttttgccaggctggagtacagtggcgtcatctcggctcactgcagcctccgcctcccggattccagcgattctcctgcctcagcctcctgagtagctgggattacatgcgcccgccaccacgcccggctaatttttgtatttttagtagagaaggggtttcaccaagttgtccaggatggtctctatctcttgacctcgtgatccgccctcctgggcctcccaaagtgccggcattacaggcgtgagccaccacgcccggctaaaagaataatttttattttattgtttattttattttatttattttattttatttttattttattttattttattttttattttattttattttatttattttattttttgagacagagttttgctcttttgcccgggctgaactgcaatggtgcaatctctgctcactgcaacctccaccttctggtttcaagtgattctcctgcctcagcatcccgagtagctgggattacaggcaccagacaccatgcccgggtaatttttgtatttttagtagagatggggtttcaccatgttggccaggctagtctcaaactcctgacctcgtgatcagcccacctcggcctcccaaagtgctgggattacaggcatgagccacctcgactggcctaaaagaataattttaaaaaatctttttttgatcaggcttggtggctcaaacctgtaatcccaggactttgggaggccaaagtgggtggatcacctgaggtcaggagtttgagaccagcctggccaatatggtaaaaccccatctctacttaaaatacaaaaaaattagccggggttggtggtgtgcgcatgtggtcccaactacttgggaggctgaagtgggagaatcacttgaacccgggaggagaaggttgtaggtagccgagattgtgccactgcactccagactgggcaacagagacagactctgtctcaaaacaaaacaaaacaaaacaaacaaaaaaacaaaaaacagcaagcaaggaccccatggcctgcaagatccaaaccagtaaaggagcagctcctcagagacaggcatgtgcattagagagaaaaagtatgcttaacatgacttcatatgataatcagctcattaaaactcatgcatatggactacatatcatgcatgtacttaaaattatgggatggaggcaacgtgcaagcacacaagggccaaagtagctaagcacctgtcaatcaaaagacaaacactggctaaagattaggcatccctgtgaagagaagaaaaaaacacacataaaaagacccaaagtacaccaaactaatactgatctcatctcccagactctccccactctgagagtgttactgtgcttaataaacttttgctttgctttgctgctttatgtgtgtcatgtacagttctttgtttgggacaccaaaagcctggaacttcatggaaccatctggtaagaattaggattttttttcctaagggttaacaaaccggccctttggaaagacttgcctctccactgttatcaaccaatggcctgaaactttccctcccttttgtggttttgacaaaacaagcaagcagcattccctcctgataagagaccactgacctaggaatgattctggccagactacagaggatgtacagtgagggttttcatgtcctctgcttcagcttttgatgtcagagggccacaaactcctccactctcagatgattgctaatgccaccattttatgaacatgggccccatggagaggcacgaagctcaattgcacttctgcacatttttcctcctataaatattgctattggaatattatttggtactgctcccgtgaaagatacatttgcggaatgtactcaaattagaagcatcatgtaaaccctataatgtagcaatagtgcatcaacttccctacactatagaaatatctgcggtgtagacatttccacaatgaccaaagatatgtgtacaagaaaggtggctgcagcattctttgtaatcctaaaacaatgaaacctacctcatctcaaaaactttatttttttatttttattttttttgagatggagtctcgctctgttgcccaggcgggagtgtagcggtgcagcctccactggtgcagcctccactgcagcctccacctcccaggttcaaatgattctcctgcctcagaatcccaagtacctgagattacaggcacatgccaccatgcctggctaacaaaaacattttgaaaagggttaaataaataatgcacaaactgaggaaaaatactgttttcaaaaatgatggagaggatcactatgatgatgaatgattccactggtcacattattgatagaccaatcagtaaatccaggcacatcctggagatactactggactcctattactaaaatatgaaaaaacggagacaagtaagttactcatttaagcgtataatcgactgaattagaattttatcacaccagaagtgggttcctaggtctctgtttcaggattcctgagttacacaggtgtaaacccgccgtttcaggagatacccgattaagaatctggtcggggagctggctggcccttgacatggatcagtcataaattagtggctaattcttccccatttatgtagtgattgacaatacgtgcatgctttaaaagttccaataagcatccctgggtgggctcgaaccaccaagctttcggttaacagcggaacgcgctaaccgattgcaccacagagacaagcactgctaactccactgggccatataggaagggcgcactcactaaacttcctctgtcccttctattcccagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggagtagatcatcatgaccctctgtgttccttttggcaaatgacttgcttccattgtttgtttgttcaattgtctgtttgttaaataaataaaaccctttttatgtatctttaaaattacattggttctattattttatgattacaaacgatgctgcagtcatcattcttgtacacttctcattggccactggtgtatttctatagggtggaggcctggagagcagttgttccagcatagtgtttacatagcttttatttaattccgttttctttcctttgttgctttattagctataacccttctcttatttcagtggcagctttagggtttctgggatacatctttaatttatcacattctgctttcaagtgtaattatacctccctttctggcctttatcctagtgttacgtatttttactttatgcattataagttttgtgattatcattaccttcatttattatgtcaaatatttttaaaaagatttaaattataagaaaatgtgtagtacatgctttctaaatgccatttccaatatttgtttttgtataggtccagatttttatctgggatccttttgcttctgcctggaggactcttaagatttcttgtagcgtgggttggtgaattcttttagtttttgtatgtttttcaatgtccttatttcactcacagttttgaaattttatttttgcatagaattctaggttaatttttttctctagtactttaaaaatgttgccatttatgaagcattgccatttaaagtatcatctttcatgtgcttgtgaaaatggcataaagccggtttcttgtgctggttatgtaattttcagaatgtgtatttaaatttaaaatattaaattttcctaaaaaactaaaaatattaatcatgaatgtcctagattcatcttaaattccaccaacagtgcacttaaaatgtgcccaacctgagggtcaaacctacctgctgacatgtaatttgtgtttgtgagacattctcaacagcatttgctttccccagctgagtgatcttcctcacatctgaatgtcttcagtgcaaaaggaaatgtttttcttcgcaaaaatactttcaaatactcttacttcaaggaagtgcattaaaaacaaacttctcatttgcatccctggaattcaaagccctaatcaagtgcttcaggatcaagagctaaacaggggaggacaaagcgtggcttcttcactaggagtcaagccaaagtcaactggtttgatcgccaacgtagatcggaactcggttcaccagcgacctgaggacccggcccagaagagggagtgtctcttcatggtgccttcagatagaaaatctcctaggatttctttctttccctttgatctacttccaactctccctttctatttcttcaagacctttttcggatccctactgcgaaggacctaaggggccggtgcccttccccactggtccctccctgcctggtgtcttaggagcccaagctcacctggaacattactgcccgccggagacagcgagaggaccaaggagcgcggcggtgcggtgggaaccacagcgtcaccgctcacctgcgcctcgtgggctcctagaaaattgaataaatgccccctgaagcttctctgcaggtcacacggaagaggagggtggctgccgacacgcgggagaagcttcaagaagcgtcgggaggacctacctggtcctgcccctgggccttgaagacaggcctggccaggctgatttggtccggtagtctcaaagaaaatgttcaagggtggcccaaacctccaccccaagattaaggctcttaaatgtctgacggttttgagactcgtcagtagaatcaatcccgcctgtatcaggagactcctttgccaaaattcaaagaccaagaaagagaaagattgggcaggttaaagtctgtaattaaccaaacaggagacagaatttttctgagaaattgtatgtgtgctgtgagaaaaagactagcctcaaggagaatctgttcttttggcttaattgtaggaaagaatggaattgccaccaacaatggtacgttgaaacggcaggtgcatcaggctgtagatgtgaaggaattaaaaatattttaccccaaaatacatttctttgacatattttgagatgtctgttcagaaagccagctgcagaagtagccctgcaaagttgtctttcgttggggagatttgcatctgtagggaatctgcattgatgcagccaagtctttccttgcccagatctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactctaatggtacctggttttggccatgctttgagcctttattcattctgttaacttgagacggtatataagcctctgcatcccattgtgtgtttcactcacgtccatgtgaagagaccaccaaacaggctttgtttgagcaacaaggctgtttatttcacctgggtgcaggcgggctgagtctgaaaagagtcagggaagggaaataggggtggggccattttataggatttaggtagataaaggaaaattacagtcaaagggggctcttctatggcgggcagggatgggttcacaaggtgctcagtgggggagctttctgagccaggatgagccaggagaaggaatttcacaaggcaatgtcatcagttaaggcaaggaccagccattttcacttcttttgttgtggaatgtcatcagaacaggccatttaaatttcacttcttttgtgattcttcagttatttcaggccatcttgatgtctacttgcaggtcacaggggatataatggcttagcttggtctcagaggcttgacattcctgtcttcttatattaataagaaaaataaaacaaaatagtgttgaagtgttggggcgatgaaaatttttggggatggtatggagtgataatggacgatgtttctcagggccactttgagcgggattaggggaggtgtgggaacctagagcgggagaggttaagctgaaggaagattttgtggtaaggggtgatattgtggggttgttagaaggagtatttgtcatatagaattattggtgatggcctggatacggttttgtatgaattgaaaaaagaacggaataagacaaggagaaaaacaggtattaaaggactaagaattgggaggacccaggacatccaattagagagtgcccaagggggttcagcatagccctgccatcaaagattatttatttactttaagagggagttaagagtggcaaatctggggacagcaccaggagatataagctgtgatggcttggagaaacagagtaaaccgccagtttaaacaagagcagagcatttatgagtagttgagaacggtgaatagaagtatgactagacagaagatagtagtgatgacaagtttttgggggcacagtccaagttggtctggtgtctggaatgagactggggcctaataaaaaggaacatctatacaggagcttaaatgggctgtaccctgtagcattctgaggacaggcccgaattctgagaaggcaagtggtaaaagtattgtccagtcctttttaagttggtggctgagcttggtgaggtgtgtttttaaaagaccattagtccgttttacctttcctaaagattgaggaccgtaagggatatgaaggtttcactgaataccaagagcctgagaaactgctcgggtgatttgactaataaaggccggtccgctatcgcactgtatagaggtgggaaggctaaactgatgaatgatgtctgacaaaagggaagaaatgaccgtggtggccttctctgaccctgtgggaaaagcctttacccatccagtgaaagtgtctacccagaccaagaggtattttagtttcctgtctcgaggcatatgagtaaagtcaatttgccagtcctgggcgggggcaaatcccctagcttgatgtgtaggaaagggaggggcctgagcaatccctgaggggtagtagaatagcagatggaacactgagaagtgtttccttgaggatagatttccacgatggaaaggaaatgagaggttctaagaaacgggctagcagcttgtaacttactgtaggaacacaagatgactgctttgggggtagtgttgggtagctgctattgtgctaagggctgaaattgactgaaattacctacaatttaccaactgggccttcctccagaagttgcaagccatcagtaggctccagagctctgaaatatttacatcagacagatcctgcctgtgcagttgttgtctagattccaggtgcttctcattccaccatcttcccaggatacactctgagcttctggattttgaattcagtcaagctgttctgtaacagctggggtgaaagccagcaatgatcctgctaagaaagctccctggaaaaaaaaagttcaaaagtaacataaatatcaaactggaaagaaattgatttaggaaccaaacccaggttgtcatggtgaaaaaaggggcagaaccttagctactgaactgcagcctggggtacgaggtgacaaccattgcttttttagtttggtttggctagcaaaggtggccttgttatataaataaagcccctctggtagtcaaaacctttattttctctctctctcttttttttttttttttttttttttgagaaggagtcttgctctgctgtccaggctggaatgcagtggtgtgatcagggctcactgcaagctccacctcctgggttcacaccattcttctgcctcagcctcctgagtaaatgggactacaggtgccagccaccatgcccagctaatttttttgtatttttagtacagatgtatttttagtagagtttcactgtgtttgtcaagatggtctcaatttcgtgacatcatgatccgcctgccttggcctcccaaagtgctgggattacaggcgtgagccaccgtgcccaatgaaaacctttattttcgtgatggctgcttatttatttatttatttatttatttatttatttatttatttattaatttttctttccctgctctccctctttttaaatttttattatttatttatttatttttctgcagagatttatccaattcagaggtcttgtccccataatttggaacattcctttggatttgatcaagtcagatagaactggtcaaacccaatggggaaaagaaggaaacaacaataaaaacaaacagaaaacaaaaaacagttcagaaaattaatgatcgcacaatttatatgattgcttagcactctaacggtaagaagaaattatgatcagttggttgttaatcttttttatttttttattttttattttttttgagacagagtctcgctctgtcgcccaggctggagtgcagtggcgcgatctcggctcactgcaagctccacctcccgggttcacgccattctcttgcctcagactggttgttaatcataactttaatcatttaggagaatttcaagacaaaacacaggttcagttacttacctaggaatagggcccaggctgaagactgctctgtaccatcctagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaaccttagatctcgatcaaattttgggaaatcagggattctctggagggggtggatctctgaggcctcagcaaattttcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaagtatagcagccaggtgcaaattgtgggggcctggaaataattttggtataacacagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccactcgctgtttagccctgatttgcatatgagactttgtgctagtcatctggtaacttttcactcagcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactttgaggtgggtgaagattagagcctggattaatcaagggcctgtggcttctaacaccatcagttgcctgtactcagccaccttcagcagtgctatctggctctagagagccatagcattccaggaaaggaaagaagtctgcacaaagccctgatgtttgtgtccccccatctagacagacatagtagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcatcaatgaagagtttcttcctcattgaatcactaacacgttttggatctctctgacttcctagtttgctgacctctgacctctagatccagactttaaaggcccatgttattagattagtcaacctttataatctccccattttaaggttaattgtatctgcaaaatccctttgccatacaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgtattatctgagttcctttctcaggaaaccaagcgttgggccctccagatagtatcaaagaactgaaatttaccagagtaccacatctggacaatgaaatgtcagaccccttatcccatcaaaattgcctaagtgaccacctgcttcctgttgaccaattcctctttcttacctctccctaattcctgttttcctgtatgtagttccatttcttccctgctatctaaaccctgaattttcattggtcaggaagatggatttgagactgatctcccatctcctaagttgtagtacctgatgaaagccttctttcctagcaaagctagttgactcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagagtacaattataaatacacatgcatctaatagagcctcaaaacacaggaagcaaaaagtgacagaattgaagggagaaatagacaatttaacaatagtagatggagactttaataccacaactttcaatagtggatacagcaactacacagaagatcaataaagaaataaaagatttaaacaacataacctaccagacatctatagaatactccactcaacaaaaacagaatacacttcctctcaagtacacacaggatgttctatagaatagaccatatgctagcctttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccacagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctataattccaatgttttgggaggccaaagtgtgagaataacttgggcccaggagtttgagacccacctgggcaacatagtgagaccccatctacacaaacacacacacaaaaaaacacacacacacacacaatagctgagtgtgatgacatgtgcctacagtcccggctattcaggaggctgaggcaggaggatcacttaagcctcggagtttgaggctgcagtgagctgtgatcatgtcattgcactccaggttgagcagcagagctagaccctttctattaaaaaaaagcaaaaaaaaaaccaaaaaactaacatgcttccccagtgggggaaatatgtcagtataacattggtttgcagcaagaagtatattaagatattgaccaaaatccttttattatttattttgtttttattttttgagacagggtctcactttgtcatccagaatggagtgccgtggcatgatcttggttcactacagcaaaaaacacctggacccaagcttgcagtgagcaatcatgtctcactgcaagctctgcctcctgggttcacaccattatcctgcctcagcctcccaagtagctgagactacaggcacctgccaccacacccggctaatgttttgtatttttagtagagacgaggtttcaccgtgttagccaggatggtctcgatctcctgacctcatgatctgcctgccttagcctcccaaagtgctgggattacaggcatgagccaccgtgcctagccccatgcctggctaattttttaaatttttttgtagaggcagggtttcgtcgtgctgcccaggttggtctcaaactcctgagctcaagtgatccaacaaccctggtctcccaaagtggtgggattacaggtgtgaaccactgcacctggcctctaaatcgatataagtcaattattcacacactgagaggaatattcaggatttttttcttataatataaatgatgtggaaatctggagaaccaaagaagaacaccaagactatctaaaagtgttaaatttttcattaggaagaaaatgaattcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgctgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttagatacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacatactataaaatttacccattataattgtacagttgaataatttttagtaatttacccaagtagtgcaaccattaccataatccatgcatttgtttttaatttattatttgtctgggttctgattctacttccaccacaagcttcagcatggcagtatctgccaccacttgttttggtccaagggcagaaatgagcatcctggaaaccaatcagtacttgcgctctgaactggaaaagtgcaaacagaacttccaagacctcacagagaaattcctgacatccaaagctactgcctactgcctggccaatcacctgcagaaatgtagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggtgagtgtagtgaggaatagagactaaaaccttggtttaggcatgaaactgtctttcccctctcagcaatgaatatcagattccacaaacatgtaacatcactgttggttaaaacatctcaggattcgatttaaacttttttaagagcgcccatttgcaaagcactgtgccaacagcatcaggggtgatagaagtaatagtataccctatctgccttgaaggaacttaaaactagctattctcaactgagtcacagatatgtggagatgtgaacttcaatagcagacatggaaaaaagtctttatgatacctggatcaagattctcttcccacaaaagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacctgttactaatagtcagggaagggaagctgtaatgacaaggaaacatgggaacaagggcatgagaggaacagggatattagaagaggattctggttaacatagaaattgagtttgttttccaatttctacaattattttaaaatacatcattgtgtggggggtggctaaaagttgctgtctaacttactgtcatagaaaagtaaaaccaaaagcccacttattaaagaagtgaaaagatgagctttggtgtgtggaaaaactagtttaaaaaaaaaaccttcactcattataattgtaggaaaaaaatttctcaagctagagaagaagaaagatattacctaagaccctagtataaaggtattattgtgcagtgattaaaaagcatataccctggggccaaatttcctgggttcaaatctaacttatcatcactgtgcctcagttttctcatctgtaatggtaatagagtaggaactacctctttggatggtggtgatgatcatatgatgataattcttaaaaacctactgcaacagtaccatgacaaacactatgtgttggttctccctttaaaacaccacctattagcttttgggcacatatcatttggatctttctcctctatatacagttttacacagctgtatacagataaatgtttaaatctttgaaatattttgggattattgaaactcctgacacaggaggaccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtatggtggggcacacttgtaatctcagctacttgggaggctgaggcaggagaataacccgggagtcagaggtgcagtgagccgagattgtgccactgccctccagcctgggcaaaaaagtgagattccatctcaaaaaaaaaaaaaaaaagaaaagaaaaacatgtggcgtcagacctcaggggatgtgaattctgactgcctcattccagctgaatcatcttgtcaagtgactttatcaggcttttctttcctcatctctaaaacagggagtagttgagagactgaggaatacagatatggaaatcccagcgtaaagcctcgtactggggatacttttatccttgagatagaccctgcctcctgccctgcaggcagtgaccacagcagcatggccagccttccatgatgcaggcatgtctatcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagtagggcagctcaggctggtagaacaaagagcaaatttgtgcaaggagaagggcagaaatgtatgactcaggcacagaactagactaagacacaatgaggttatggtctagttaggtctctagggttttccattaaatagcatattagtaaaatggagacagctgtctgcattggaatactagcaatgtggcttctatttgtgtgtccttggtcaaatttacttcacttttctgcgtgtcattaaactaggctacctcatttataaaatgcaaatactgacagtatctacttagagggttatgaagattaaatgcacaattgcaagtagttagaaccatctctaacacatataaaactctgaacaactattttctgtaattattatatttgtccccatttatagatgtggtgattgtcattaatattttctataagagatattttcaaactttccaaagtgcctttcatgataacaatgtttctcctccaaactttttaaaaaagtattatactaggtggagtattaactggtagggctgttgggtagatagatgattgagcagctgttgtgtggaaaatgaattattaattcgctcaggaccagcattgactatccttagagggtttcagacataaggtagattgtcgcattcgaaacttcttttaatcctttgttgaaatgaaatcatagaagctcaaatttgtaaaactcaccaaagcagagatatttgattgaaggtgggataggtctggagcccctgtttctccccagtatgtgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgggtacatactaccgggtgctgtaagttgggtaataggtagcactatctttagactcacagagctcacactctacattggaacccatgtgtattagtccactctgacactgctataaacatatatctgagattggtgatttataaagaaaagaggtttaattggctcatggttctgtgggctgtacaggcttctgcttctgggcaggcctcagaaaacttacaatcattgcagaagtcaaaggggaagaaggcatggtcttcacatggccagagcaggagagagagagagagcaaagagggaggtgcacactttcaaacgaccagacctcatgagaactcactcactatcatgagaacagcaagggggaaatccaccaccatgatccagtcactatccagcaggtccctggttggattacaatccgacatgagatttgagtggggacacagagccaaaccatatcaccatgagaaatatttaaacaataattagaaaaaaaataaatccgcacagagtaatgaaattactactcagaactttactttttttctttttttgagatggagtcttaccctgttgcccaggctagagtgcagtggtgtgatctcagctcactgcaacctcaacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcatgagccactgtgcccggccagaactttagttttaactgccttcttactgattatagtctatcttcatgtcattcagaagaatactgcccctcttgaccttttcactgatttttctttttaactttcaattaatactagagataccggcccaacagttttgaacttggcttttttttttttttttctgccagttactgcatatgaaaaggtacatgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacactgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggagtcagaggcggaggttgcagtgaaccgagatcacatcactgcactccagcttgggcaacagagtgagaccctgtctcaaaaaaaaagaaaaaaagaattcaacttgggagttccttacagggattctaagagatctctcctctgaaacttctataacctattattcactacattccctcatacattttactcttctttcccaccttaggatacatgatcccttaattcaggctcaggctgaagaactgacccacttacaacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgccccaaagtggggagaaaaaatgcaaacttatctccattatagattttattttagttttgactatggtccttaatctgcattctattgttttctctttagagcactcaggtaatcacttttcatattctttctagaattctaagttttgttttttattttgagacagagtcttgctctcttacccaagctggagtgcagtgacatgatcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggctggtcttgaactactgagctgaagtaatccacctgctttggcctcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccactgtcttctggcttacactgttccaacaagaagtctgccataattcttatttctgtttctctgtacataatatgtcttttttctctggatgcttttgagattttctatttatcactcgtttgaagcagtttgattaagataagaccttgtatagttttctcttttacatattgttctactttatttagtttcttgcatctgcatgcttatagttctcatcaaatttgaataataatgacatacatagtcttacctatggcatatacaatatattatatttggcatatatacatcaaatatatataatgtatattctattctttctctctatcttctccttcaaagactccagttatatttatattagctgctttgaaattttaccacagctgactaatggtctgttcatttttgttgtatcttttctttctctctgtttctttctatttccatgtcttggaattgattaatctttcttcagcagcatctaatctgctgttaatcctatccagtgtattttcatctcagactttatttttcatctaaatttaatttatgtctttttttaagttcttctatgtaactcttcatcatttcatattttcctctagcttctttattttattttattctattttttgagacagagtctcgctctgttgcccaggctgaagtgcagtggtgagattttggctcactgcaacattcacctcctaagttcaagtgattcctgtgcctcagcctcctgagtagctggaattaccggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcctttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctctccaagctggctttttaatttttttcaggcagcataagagcagctattagtcaactgctattttttttcccactatggaggcaaaatgacctttaagaaaatagaccttattttttagagtagtttcagattcacagcaaaattgagcaggaagtacagaaagttcccatataccccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcacgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccgatgctaatctaatgccatcgttgatctgacaggaggctgagctcaggcggtaatgctttctcgctggctgctcacctcctgctgtgcggtcccattcctaacaggccatggaccagtgctgggggttggggactcctgttctaaccaatgctccctctattaaaagggattttcacactagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgtcttcttcaaagttactaccaggctctgcctgggtcctccctccctgctctacagttgacaatctcaggcagcaaactggagcaatcatagggctcacctcttttatttattatagtactgcactgtatccaatgttgaagatagagtttaaaatactttttccagtttctcagttgtttaaggtggaggacaaatcaggtccccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccaaggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaagaattacccccaacaacatctgaggaagcacaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcagccaggcaagtattctttgagctggggaacaaaaggcatttaaaactttttgctctgcttcaggcagctgacgtctggtgatgattcaccatatcaggaacaccctgtccagtgggctaaggcaagcctgccaggccacttctctaaagacacaacctgaggcctcctgcaataattctcacagagcattctgaacatacatgtaagctgttatgtccctgatcatatagggcccatgtgtgcaatgtgtgaaatgggacctgcttaatttctgactagctctttctaattttggtttgcagaaaatcacaatggtaagaaaaatgaagacaggcaaaagccactggctcccaggtaactctacatgatgaaggggctgataatggactgaccaaatctagagagaattccagaagcaaggactcaagaggttgaaggtcccagatctagaaaaggcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccgtgggaggttgtgttgtctcaagagccagtattcagtggaccactccacatcatatcaaataaaatttaaacacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcattttacaaggtcaggagttcaagaccagcttggccaacataatgaaacctcatctttactaaaaatacacacacacaaaaaaaaaattagccaagcatggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaggttacgtttcatttccatatcattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatggtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttacagtctattggatattatggtgaagggcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagatcgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttgaatcaacttcattcatcatggaagaatgttccattcataaacagattaaagagtaccttagatccatagaaggtgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgatcatgcgcttactctgagaaacacaatactgtttctgcatcataacaaagatctagttgtgcaaactgcacagccagaccaacccaattatggttttcctctggatctcttatgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttatgtttatcatatcactggacaaggaccaccatcccttttattatccaaaggtacaagacctcgaaaactgccagatatatttcagagttacgatcgattgctaataacatcttggggtcacgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccgctgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtgtgtatgtaacttttacagtttttcagctgaaagttgtatttttttttaatcagggctctttaatctcattttaatttcctttgtttgaatgaactgtagttattttttgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctaaagacctctcatactctcaaggagggagagtgcatttttagagcttttagcaaaaatgtgaaaagttcatgtttgcactttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccaacttctttaatgtaatttaaatcctggaaaacattttttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcagaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcatatgcaaaagggctatgagtaggaggaaaactcaggcctctgaggtctcctgaaagagttttgctaatgtcacaactggctttctatgttatctgaagattgagatctccatgaagagtgaagataggtaatgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatacttgcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcatctagaggggtcttactggaagccttttactcagtccctttaatttccttgggtgtatactacggttccactgacatggatgacctggtagtagcgcagcagcctgaaataccagggtttccttagctgtggccttagctgctctttccaaaagggaatttcctctaataagaacagtgtcttccttctggtgtcccctgcagtgaatacttgttatttctttgggaattggacggcatctaaaagttccaagatctgagtaaagttgtatgggggatcccttggctcttgatagtcccctttccttccctatggttgcatgagcctgaagcacccggaaaccatacttagagtcagtaaacacattgactcttgagggtttttttttcttttttgaaacggagtcttcctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacagtcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccattggtatacttttgcctctaggaccctctgtactgtacttcatggggtggtggggggcgggggtggtatggcatctacttgttgtcccaaggtaaacttactggcttcttctaccaatagagtgatggtagccacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagtttgagagtcttgaagcaggggctgtccctgggttttcttttaaggctaagaatgccttttgacaggctccattgcaattcaaaggcttatgaccactcacttttggaggttcgtagagtggttttgctatgagcccaaacctgggaatccaaacccagcagaatccagctattctcaaaaaggaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgtaataatccatacttcattatcaggggatggatgccccttggagccaaaggtctaaaaggatactggatttttctttttttttttttttttgagtcagagtcttgctctgttatccaggctggagtgcggcggcgcaaggctcactgctacctctgccttccgggttcaagcaattctcctgccacagccttctgagtagttgggattgcagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatattttttttcccatagataattaacactgggtttcaaaataacctggactgggagaacatttgcagttcttccaggaactaccatgtcacaagcagacgggtctacttgagaagtaatatttgatggaaggaacgtcttttctttatctgtgttaagacatgaacttagagctaggagaagtgtcccttcccagcctgtggccttctcttgaggtgctccaaattgaactgcagcctgttattgggaaagtaagtctcttcccagtaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggccccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccgagaagctcagactccgtttggagactgaggcagtctttcctccagtggccctcttgcttacagaaggcacactgattccagcctaggggatgatgagctggcttttgtctgggcatcccaaagccactcttgcaacactttctcaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagagcccgcccttccgggttgtctgggtctacattagtatatttcctgagtgcctcaaccaagcagccctaaaacagaatgggattttcatccttccactgagttacttctctatccttgtcacaattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatacttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtgggggatacaggctggagctagctaaataaaagggagggttttctgatgacattggggtgaaatcccacactggagaactggcaggacccctcgcagaactgggggactgagaagaccctggagagggcatgggccctccagggggtgccgctaggaagggagcatcgaggatatcccacgcggtttcttggtgcctggaagtaacatgagccagacacatcctgcagttgactcttaagtcagaatcctggtagggggccatagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagaagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaaatatttgggcaaaatgtttgggtggctgctgcttgtctgccactatgggtagttgtcacttgggccaggggtccaggaacccctggtccctgtgaccaagagttcaatatgggcttgagcaaagtcacgtaggagggggcccacaactggctgttatggaaaattgtaatcttttaatttaagggcggagaagatgacatccacactcctccagggaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcactaccaagtgtcctgccttaaacagttcttgactctgtcctgtcctgtcctgtgttatatcatgtcctgtcccatcttgttttgtctttgtggtcaccagatgatgcaaggaaggacaaccccaaaattggggcttagcccaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggttattcagaactttttggaaaagggatgaggagtttccagaagcatataaggtaacttcctggccattgccatggcaagttgacatggcatttataaactgtcatggcactggtaggagtgtctttatgctaatgagcagtgagggcaactagaggtagcttttgtctccatctgctggttttggtcagcttctttactgcaccctgtttggaccagatcctgctctgatcaactgggccacaaccgcaaaataagtcctgccactttcctgcctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggcaacctacactttcttctagcagtgagaggtactgagatccgtcaccccctcctgcaaggccaagacccagagagagccaaattttagcctagaattcagccagctcttcacagtctcccatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagataaaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacatatcattagctggaagctgcctctatccatatattaaaggtttctccatatgtagtgaactgtaacctaactggatgtgtaaacaacctgtaacctactcttgagccaatgactgaggtttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtattatatattatatacacatgtaatatatatatgtatgtgtatatataatatttatttgagagagagagaagtgacttgtggtactgatgttgcttgcctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcatgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccaggaccatcaaaagcacacctgcactaggtcattgggaactttggaggtgccttacatctgggcatgcattgaaccaccacacaaggtgaaatgcctcttctcaaagaggcttgcctgcagtttccactaacgaaattgtgagtcatagctgttcttctgtttgagatattaggagggattttgtggggggtgaggggggatgaaagtgagtttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaagtggaaagattgactgagcccagcaatttgagaccagcctgggcaacatggcaagatccccatccctataaaaatttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagcgtttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcacgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaacaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggacaccccactggccaacgggaccctaggcaaaccttataaactgagtcccaggccaagaaggaacgggaggccagacaagcctcattatattcccacccttttgcaatttagacaaaactgaccaacattaatgttatcacagagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaagtttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcattatctgtgggagagttactctgaaagcagcaagaagccattaccagatgcagatctcattctgtcagtaatggcaacccagcaaataggacaggagccccacccaggttggatcaatgcatggctgtataaccttgagcaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcaccattaactccccttcttcaccagagttttctggcacccaagactacagaaactctcctgcagtgggctttggggcacatcgcaagttccagtaacaagggctaagatcgcccgcttttggagaccttacaaagcatgtattccctgaccaggaatcgaactcgagctgcaggcggtgaaagcgccgaatcctagccactagaccaccagggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttaaactctctattgaaaaatgaacaaatgttcagaacagaggaagtagagtggtggcaccatcaaaggcaggaagggccaagagaacctgatgggagtggggatatagacctggttctagcttccagtcttccagtcactaactttctgctgtgtgcagggcacaatggaagtaaacaccacccactatatatcccctgtgcctggcatacagaatcattcatacatgttgaccgaagggtttcctttgcttctaggggattatgtatcattttgggaggaagcatgtattctgtgaggttgtttagtttatgtccaagtgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtactctttatcatatgaggagagtgctaattaatgtgtcatttattttgtgagcatgctaataaatatattcatattccaatttagtgaaaaaaaattgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttctatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagctgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctctctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccatgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatatgaaggaaacatggtaaccactgcagtaagaaaagcaactgctggagaaaatggcactttcttccccaaatttgtttttacactcatgtctaaggaacaccttagaaaccacattaacatctttcagcaaaaggaaattctgcctgttgattttttgctgtgagacaaacttgaaaagttcacagacactgcctttctctgaaaactgcccttacctctttgttacaattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcctgtgtccttcagtggtgatggctctgaaacccttgtgttttatgaacttcatgccctggtcttcaaacgaattcagtgcaggccaagaagcacagtttggcctgggttggatgctctatattttcaaacagtgaaatgccttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcaggtcaggcccttcagcctggtggaagagcaggcagggagggtcctatggttcctgggaggacccgaagcatgatcacctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgtggaaccgtaaatgagggttcagcctgtctgcctgagggattgtgtttcctggcgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacacgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaatcccaagaggtagatgttgcggtgagctgagattgtgccattgcactccagcctaggcaacaagagtgagactacgtcttaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagaagattagacactgcagaaaaaaagattatgaaacacaaagccgccgggcgccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaatatatatatatatatatatatatatatatatatatatatatataaaaattagctggacgtggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaccgcactgaggggaaaagtcaatgtgaaattctacaaaagctgaaaattcactaccaccagccattaccacaaaaaaaaaaaaaaaaaagttgaaggagtcctccaggcagaacgaaactgacatcggatgaaaatctggttgtccaaaaaaaaaaaaaaaaaaaaaaaaaaaactagacatgacatctaatagaagaatatataattttaacatctgactgtttagctgggcgtggtggctcacgcctgtaatcccagcactttgggaagctgaggcaggcagatcacttgaggtcaggtgtttgagaccagcttggccaatatggtgaacccctctctctactaaaaatacaaaaattagtaaggtgtggtggcccacgcctgtaatctctgctactcaggagtctgagtcaggagaatcgcttgaacccgggaagcagaggttgcagtgagccaagattgttccactgcactccagcctatatggaacctagtttgatctggagggatcttattttataggaggcttggagggggaccttttgctttgtgtactcataggatgcacaagacacaagggaacaatctctcactttttaaatacagtgataggcctgaggagaaacaactgcaaattttttttttttttaatgagatgggattctcactggtcttgaactgagctcaggcgaggcttcccctacgtcggcctctcaaagtgttgggattaataggcgcgagccaccgcgcctgaccacaactaaccaacatttaaaagcacgtccctgggtaggctcgaaccaccaactttccggttaacggccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttccacgttagaaacgcttgcattgcctgactctgaaaccagaagggcggccgaatggccttcaccctccgttaaccctcgcctgcttcagaagccagtgcctctggaaatgcctggatctgcgaccccagcctgagcctagtagggcccaagggaagctgaacgccccgacggctctcatggtagctctttctgtttttttgcgccgccttcaggcaatcatctactccgcttgctatcccctcactcaactcggcttcagtagatggggttggtggggcgggagcgggaaagaagcaggggagtcaaaagggaaaacctgaaaagaaggagggagaagcaggggagaccaggacaagacaatgggacagcccaggatgccggtgcagagggcaccggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggggaccgggagcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgtgtcttttggtttgcctttaattcctgcaccagctgcggcctttatctgcagccagaaagcaggttttaccgctggtcccacagcgccatacggtctggggaaaagaaggaaacccaatagtacacaaacaaaggccaaaagagaaaccttccaagtgctctatgccttacggtttagcagaaaatatcaaacaactctcaacctagctggtctgtagcttccacaaatgaaatactgtattcattgcagcctttctggttgagatatttcaaatatttggtggagcttttaatgagacggagagacactctcgagtgtggaagaaaaaaatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctacagggacagcacagcgtcctcgccctggccggacgctcagggtcaccaccctacccactgcccccctcgccattcttccaaaccactctctgccaaagattccaccgacagtcaccccacacgacaacccaggccgcctttcagcagcggctcccgccccgcaaccacgcgccctctcacccccgcggttctgcccgccgcctctatccagtctgtgcacttcacctccctggctcccgctctcccctgagcttacagtggacgcggggttcttccgaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcaccggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccatgtccagggcacgcacaaacgccatgacttggcttggcctctctcttagttattcacagctcagcccgataggcacctccggggcggcgacggcaaagagggtgcccttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctagctgcggaggctgttctacatctgacccttggagcaggccggctgacagcgtagtaaaggaagatttctgcgggagggcggccagtgcaaaacaattccctgaccgggaatcgaacccgggccgtgacgctttcagcaccgaatcctagccactagacaaccatgcagatgcggaaagctgctttctctcccttcttcgacctgaagcgacactttcctgtgctctaggaggacttgggtcttgtgagagtcgctctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgcgaggcggcagcaactgacaagatggtcgcgggtcgccgcgtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccccccgtttgctctgggcaaaacttcgagagttccctctgaagctggagctttttcctcagatccaagatccaattggtcaccaattcgtgatttccgtcggccaagtgcgtgggcattgatctacacgtgagtttctccacctctgccgaatggctacttcggggtgggggaagggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttttcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcagatgcgcggtgcgcggggaagaagaggatttgactgcggttctccacccccggcgcctaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatgtaaactgggtggctaattcacaacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaatgggactaaatccagactcagttattgcaatgtgtgcaaaagaacaaggacttgtactatctgacttcaaggcttactataagctattatagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctccgttcttctgtggttagaagacctgaacccaactccctccccaagcactggagatggggcttttccaagggctagggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatggggtcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagtagagaggagggcaccttttggacagaacctgtgggacaagagcgacgtctcatccgttcaggttcctcacaaaatgagagtcaggaagatcagggtgcagacctgatttcccacgaagggctgaaagcagacaaccagagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagttttttttttcttcttcctttttttctctagctaaacaagcactggccttgagataagcaatgctgaagcacttgcagctcacctattaccaaaaactgactgagccctccctacacaagccataactactgctttgattggacaagagactgatttcagtagttttctcttggtaagagaccactggccgtgggctggttctggacagtttacagaagctatgcacttgattgcctttgtgtccctgcttcaccttttgaagcatagggcctaattataatgtatttaaatgttgtctccaccccaaagtgaacatgggttgcatgtaacaggcgtgtttactcagcatgcatgcagcaggatcccttcacaaatattcagagctccccctattccctgttgaatatgtatatgtggccaaccagatcaacgtaaatcactattcgccctcccctccctggaaacttacttttcgggtttcagcaggaagctatgcctcccagtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcaaataggcctttgcaaaggagaatttcttatatgctggaagccataaaaaaatatgcttcatagtattgctcattaggcaagtacaaattaattccacactgagataccactaaccaatcaccagtgtgtggctacttttttttttttttctgagacagggtctctctcacccaagctggagtgcaatggtgcgattggtgcgatcttgagtcactgcaacctccccctcctgagtagctgggactacaggtgcatgccaccatgcctggctaatttttgtattttcagtagagacggggtttcgccatgttggccagtttggtctgagagcatagctacattttaaaaagttagcacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccagtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtggactaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctacaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcctggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccctccgggagcttcatttcttgttcctctccgtagtggctcagcggtaagcccaaggtccagcacacgaatcaggaaactgatggttcttgggttagcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatatcttttgctgctactttggtcagcgttgttgtcagtttaccttgtggtggccaagcccttaaatgcactattaggttatgcagtgtaattctgcagggcagaagggtaaagagccatagtgaagagcaaaaatacctcttatcttgaccgggaattaaacccgggtctcccgcgtgggaggcgagaattctaccactgaaccaccagtgcctctctctagcaaccctgggagaattatcaaaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcagtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagtagagagatttcttttctcaattttccctggagagattaaactgaagagaaaaattcagagagtttgccccacatgttgggtctgcgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctatatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaatagcgtttaagtttattggatactccacaagcttactgccactttattaccacacttttccatctatcggctcttgcatccattaacataagcagacaaaaaactggactcctggccgggtgcggtggctcaagcctgtaaccccagcactttgggaggccaaggcaggcggatcacgaagtcagaagattgagaccatcctgactaacatggtgaaaccccatctctactaaaactacaaaaaaaaaaaaaaaaattagccaggcgtggtggcacccatctgtagtcccagctactcgggaggctgaagcaggagaatcgcttgaacccaggaggcagaggttgcaatgagccaagaccacacaactgcactccagcctgggtgaaaaagcaagactccacctcaaaaaaaaacaaaacaaaaacaaacaaaaaaaaaactggactccctacagccagtgtagtatgcaccactcacttgccacactgtatgctgagtgacccttccacagcttaaatctgcacataacttcagcctagagccatataatgtccctttatttcttcagtacaatgattaataccatattctctgtacccttcttccctctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagctgattcacctccttggtgagggctctctccctggcttgcagactgctacattctccttctgtcttcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccatcctctgcagtcatcctgtcagtttccattccattctcctatccctggcttgctggttcaatactcttaagtgatttactgctggtgctcttctttttccctcagagataccttgtgatttctttgattctctccacctctacaggttaataagtctaatatttaaaaactctgtagaaggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaaacgcactgccgagaggccagaaggcaaagcgagagtcggtggctatggcctggaacccatttaggcaaaacagagggcgcgcggggacaaagcaatagagaagggtgggcaatacaggatctgtacaccatacattaacaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagagctaacaaaaaaaaaaaaaaaacttatgtttccgcccggtttcgaaccggggacctttacgcgtgtgaggcgaacgtgataaccactacactacggaaaccacaggcggaacctgcacggcaaaatataaccatgaaaatcttagatcagccgtttctattatagtttccaaatccgagatcgcaccactgcactccagcctagacgacagagcgagagtctcaaaaaaaagttgggagaagaaggtgccattttccctagttgcttttcttactgcggtggtgaccgcattgccttcacacctgaagtccaagtgcttccaccctgcagaatatgcagaccgctgggtcactggacgccaggccgcagcgccggcctcgttctgcttttggctctaaatgcagtcgggggacgcgactggacctcaccagagactggtgggctgttacccttaccagcgactggagggccaagctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatcctcacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccaaaggaaaagcgcaaaggcggcccaaccccacgacctgagcaagccaagggtcgcgggttaaattgcgtttatcagaacagttgtttgctcactgtcccaaagccctcctagggacaaagaaaacactggcatggcaccaatcgcagaagggggcagcattgacacccaggaacaggagtggaaaagcaggaaaagcagggatcatctctctcctaccccgtatatggctgcagacatagcagtggttcttttctccaggacccagtgagtgtgcaccaggagagaaaattatgcacgttattcatggtggcaccacccaggctgaaagtgagcctgtgctgcttgggctttcaggaaggacggacccaactctccctccctatacagagctgcagtgccctggcaatggaggacagaccatggagttgcctgccctggactcggggaagaggctctgccctaaaccccattttagtggtagctgtcagagtggcatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactgaactgcatcctaaactggaccactgaattcaaaaaccctgctaccaaagggcttagtgctagtccatgagataagtttcctgagaattccgtaccctcagcccccaacaagggttagtgtgttagcttttacttccaacacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaaaattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgttggaaatgacagataagaattccaaatacggattgcaagggaactcaatgagatccaagaaaaagttgaagtccaatgcaaagaaatcagaaaaacaatacagaatatgaaagacaagaaaactatattaagcaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccattgaaaagcatacagtcatcagacttcccaagataaatgtgaaagaaaaaatcttaaaggcagctgaagaaaagggccagattatctataaaggaaatcccatcagactaacagcaaacttttcaacggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatataaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaggcatagggtggcaaattgggaaaaaaaaaaaaatcaaactttccatggcctttaagagagacctatcttacatgttatagcccccagaggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttaaattggactcttgactaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaaattgaaacaaatgaaagtagagacacaatgtgccaaaaactctggaatatagaaaaacagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcgagcagaactaaatgaaacagagataaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttgaattcctggaagcacacagcttcttaagattgaaccaggaagaaattgaaatcctgaacagaccaataatgagttatgtaattgaatcagtaataaaaattctactaatctgaaagagccctggaccagacagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaattctcaacaaaatactagcaaactgaatccagcagcacatcaaaaagataattcatcatgatcatgtgggctttattcctaggatgcaaggatggttcaacagacgcaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcaggttacaacatgagcatacaaaaatcagtagcatttctatacactaaaaatgctcaagctgacagccaagtcaagaacttaatcccatttaaaatagccacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcacacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagctgagatcatgccactacactctagcctgggtgacagagtgagaccctgtctcaaaaaaaaaaaagaaaaaatccccatggaaccaaaaaacagcccgaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaactaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcttatgactaagacctcaaaagcaaatgcaacaaaaatgaaaattgacaaatgggacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaattctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaaccttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcgccacagccagaagagtgactctgagtatatgaatgaggggctacagtggactgtccagtacctagggagggagagacagggctgcaatgaagtctggagggatttaggaaattcattgattgtaccaaacaaaaacttacatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacacgtaggtgggatcttttaagaagcagccttatctagattgggaataagctattatagttttaggctgtgtggatctggtcaacttttgtgctgcctacttctctttgcttctacaactgggcattgctgcagaaaggaagaaatatggaagtgacttcagctttgattttcttccttctggaagcctgaaaactccagtttgcttccctgagcccttttcctgttgcacaactagggtgtggactacaggtcctacccatggaagatggaggtagatacttcacagggaataaaaacaacctagacaagtcatacctttaggtaacagatactttcaaagatgtactttcctgcacccattaaagttttagtctcagctaatctgaaaacctgcggtcctcatgcactgggatagcagtgcaatatggctcaggctcaggttttgctgggcacaccagagtaggccacacactctcatgtgcagtggcttcaggtatggatcagggtctttcccactaattggcttcagttatgatgttgtaggtcatcattcttctggctttaatatgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctccagcctctccctcaggcggtcattgagactgatggactcctccaggcgctggcgcaggttctgcatctcagcaagattcttttccagcaggtcggcccctactgcaaaccaccaagacataggagaggtaggaggtagggaagcctgatcatccctgggcagctgtggggcctgcctggcaactctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagagggggaacaggagagaagggaacaatctccaaggaaggaaaaagatgcacagagagaggaggctgagaataggcctcacccactgggagattttgcgtagggtcaggtttttctctgagaatttaaaatgtcttattgttacactacctgggacacagaaatggagctgcttcaagccattcctctaaatacctgcactcctagctgccaggtgccaggatgtttggctccaaatccaaaagcaatgtttatgggggcaggattggcacgtggttgtatgcacagtgtgtgtgaaagatgtgtgtgaaagagtggaaagagtgtgtaggggtgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtaagttcctaggtagggtggctaggagaaggcactttcaaagaacaagcactgagctggttctcactgtctggctgatctacatattgtcctgtcattttttatgaaccaggttctaacagaggaaccaaaaagtcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaatgagtgttttaaaggtaattatagtgagttgaatagtgtcctccaaaaattcattcagttcacttggaacttcagaatgtgatcttatttgtaaatgggttttttgtagatataataagttaagatgagatgatagtgaattgggggtatgtcttaaatccaacatgactgatgtccttatgagaggagaggagacacagagataaagagacatacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttaggcgtcttcatctccagaactgtgagagaatacatttctgttttaagatgcccagtttgtgtttttttgttttggaagccctcgaaagctaataaagcaatccacggaatgaagactaaggcagatgtcagcagactcatttcccaaggactccccatttcaccctaaagtaactggcatttctcagcctatgacataagcagtagtgttagttgtaatatctgagcatcacagcgcacatacaggaaaaatatggggcccctctcctagcttcctttatgattcccaatgctggaatgaacctggggaggtacttcagaaatgtttctcctaatagcaggactcacagccaatcctaggagttcagacagtgaggggtgaagcattttgttggtctgtaaacaggtgactatttattcaacattctatgcccttgccagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccacagaatagctagtgtactcttgcatagaggattgtagaatcacaaaatacatggcatcttacagctcaatgatgccatgagaacatggccagatcctctgggcccttcattactgtctccctttgagagaaaaacccagctggggtggcagggccataattcagagaaaagttttagagtctttccctttcaaggattattatcaagggctaaagaatagacaagtttctcctctgagcaggtgggagtgaggtttctgtttgccctcaacaacatcacgttcttttaggaactgtatatttaaatcagtaaccagtaggtctctccttctccaatttataaaatatcagatactaattagaatcactgtgagataaagagtaatgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacattctctggccataccacacggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaaccgttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttcagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaatccattatgggccgggcatggtggctcatgcctgtaagcccagcactttgggaagctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactctgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcctcttcccgtctctatcaaggctatcccaaggaccctctcagggaaattctcaggagggacacgctggttggtgatagactcagcttgaacctcacagcatggccccattcactgatggtttagagggtgttacagcaaacttattaggatgatggatgggatctgtaaatgcataaatgataaagatgatttagtgatgaacaaaaaataggaactgttgctgtttaccccagggattccaggattaggtgcacaatgttagcaacactcatgtccctagtttgaaagatgacataattgtgtgcagtgaagaggaactatttgccccctttctccccttcccaacccatgccccccaagaccaagaccatgtatgtgccagaggagatctagtgactgatggcatgtgagactgggaacggagaaaagctacctgaaaaccttggggcttatgctcagcactgagtcctggagctgtgcccgaccaggtacatcacggtggatctacagggcccggctgcaaagatgccacctcttggcctagacaatgcatgagcccccaaaaactggagccatgtggctactcactgactacagtcactgaaggatgcacttcctccttgtcaagctgtggagacgtgctgctcagggagtgatgtggggtagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctgagggctcacaggagatgtaaaggggaggtcaagaggatcattccttcagaggagaagccaaacaaatcatttctgtttcaggatagagtatggagggaaggcggggacagagagagcaacagttgtccggtgcattggctacaaacatcctgaggaaaaacgaagccgtaatgggccccttaaataacactcatgattccttcacaaaacacccagagacccataagagttcaactccaggtatgggcatggcggtacatgcctgtaatcccagcaatttgggagaccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcatgccactgcattccagcctgggcaacagagcaagacctcatctcaaaaataaaattttaaaaatgtaaaaaaaaaaaaagaattcaactcattctgtgaacataatttttaaaatagtatttgccataggccatttaaaacagattccccaggcaatgtagcctcactggtgtcttgcagtttctagatctccttccctaagtatagagacacagtataaacttttgtttgcaagaaaaatttgtagccgttttacatcttccagcgctccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatcactaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggaccagagacttgactacctgatgcttgccttgattccaggatactctgaattttctcagatcttgggttgagtctttagagagcttgtctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgttccttctgtctttctgccaattagtttcagaggaataccatcatccctggggatgcctcctgccctaacagtcatattccatgagggatggaggtgctggtgatcatcatggcatcctcaacccttcttcttggagctcctctccagccagtcctgactctgtcatggtcttaaggtggtgattacaaagcaggacaccaggttgaaaagtgacatgtgaatgggggtggcatcctgtgaacttaggaccttgggagagactgaaaatcttcctaagctctgcggccaacttacctgtgctgaattttctggcaaggctctctgccagctggcttcctttggccagctgctcgcagtagtgctgctccatatagtggtcaaagttattgctctggagtagctcctcaaaggtctttagtgtgttcttgacatgctggatgagaagagcagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaatctctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttatctatgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaggccgggcgcggtggctcatgcccgtaactccagcacttagggaggtcgaggtgggcggatcatgaggtcaggagatcgagaccatcctggctaacacggcgaaaccccgtctctactgaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagaggtcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaatagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatgtttgacaaagggacaagggcaatacaatggagaaaagatagtattttcaaaaaatggtgctggaacagcgggacatccacatgcaaagaaagtgaatctagacacagacttcacattcttcatgaaaacttactcaaaatggatcataggcctaaatgtaaaacataaaatgataaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttacttgttggagggcatgatcatggctcactgaagcattccttgggcatgatcatggtgtgattatggctcactgcagccaaactcttgggctcaagtgatcctcttgcctcagccttccaaagtgctgggattacaggtgtgagccaccgagcccagctatatgattatttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagatatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagtttacacaaaaacctgcacatgatgtttatagcagctctattcataactgcaaaaacttggaagcaaccaagatgtccttcagtaggtgaatggataaattttgatacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagagagtaaaaagatcagtggttgccaggtgttaggaggaaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtgggttcatcagttgtaccaaatgttatcactcgggggcaagatgttgatagtgagggaggctgtgtccttgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattctaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgttttgtctgagatggaatcttgctctgtcatccaggctgaagtgcagtggcgctatctcggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgtgcctggcctagcgttattttagccctaactaacattattctctgggtcagtgaaatttaagtggaatatattgggcagtgacctaatggagcatgaagcaggatttgaatcacttccaaagctgtacaccaaccacttaggcaaagtagtgatttcagtaacttagtatttcagtaactggtgctcacaggcaaatgcgtaatggattaaccccatattatttaaatgcttccaaaaagctataggaaaatggccattaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacgtatgaagaaacaggagattcctacatgctcctggggatccagaagagagaccactcacatgactggaagatttccagctcaggtaaccacaaaggccatatatttggtgaatacaggcaatgttagttagaataaaaccaaatttctctgaataatataaagtcattactaataaaacttttatagatttttctctgaagaaatttccaggaaggtgttaagagaaagccctacaattaaggtatggaggctggctgcaggccctgaaagctgctctgatgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcagggtgggtgctgttatgagaaggaaggggaggtcccacaggtgtttagaagaaaaagcaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttgagatgccagagctcaaatcccatgtcactgggacatcaacaatagtgctatggggaagactcagggtgccagctcttgagtcacaatcacagaattagaatgtggaagtagctacagaacccaaggaagccctgccttctgatagctacactcaatgcaaggctgcgtatttcaccctggaggtctctaacaggggaggccaccccctcaatagccagcttttttacccttttgcttacgttgtcaaccaatttctaaccacagcaaaataacctaagtatacctctccttgaaaacatcaaaacattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtattactttttaatacataataaataatatatcccaatgcgatacttgcttcctttcccttgcagtagcaacgtgtaggggtttcatttaatatgaggtcgatttgagccttccaaactcccattccacccacctttgcttgcactcatgggaaggctcagtctatatctggtttgcccacattcctaggctacagacctctaggactcccagtttgagaggcgccatttttttggagggtagtgaattttgatttctgtctcctttgcatccttcccagtgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacacgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaagagaagaggccattggtagtatatacttgcatttttcttgtaatacttgcataagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattgtagggaatgttaaaatttctcactggtacagttagaaatgaaaacaaagacaataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatctattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggatatatactcaaaagaactgaaagcaaggattcaaagagatatttgtgcacctgcatcaatagcagtattacaataactaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggacattatgcaaagtgaaataaaccagtcacaaaaggaaaaatactatataattctgcttatatgaagtacctagagtagtcaaagtcatagagacaggaaataatggtggttgtgccaggggctagggagggaagaatgggaaattaatgggtatagggtttaggaactttagtctaagaaaggagaatattggatgccagaaattcagttttctttctgttccaagatccctttagctagagcgacatattgaagtcagagttcctaagggaaaatcattgtgtatggagatcatccttgtggatcaaatgtgaatcaatagtagatcaaaagatattccacttttgcagatattgacatttgttggacccgtaagattttatctagtattagatagataagatgtgaaccacttctcaacgctgcagactcaaatactaggaaatactaagaacctcaggacaaacaaatagccagtccaaaaagactcacagactagataagctgtcatctaccacctaacagataatgtatccctgttaaccactatctccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataaggtgcaggattctattagctaagattatgtctcaggtgggcaaatctctgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagtctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatacaaaatatcttggaagtttagctgaagagatgaggagatactctactgctcaatgtgcgccatgtcatctgttgtacctccccttagttaagtcaggagggcaacactccctttattttttattttattttgtatgtatgtgtgtgtgagatggagtctcactctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcggcccctctatttatcagacagatgtatagaaagtttattgtgctagcaagagtatgaagaaaaggattctctgagttgaaaaaacaaattggaatataaattggtaccacttctatggaaggcaaatttacagggcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgatcgagcaattagtaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactacatttctttccaacagagaccttcttggaggatgagaagcagccactagttgacaggaggggaagtgaggcatgtagtcttcaagggagcagaccaccgtgggagttataaaagaccagcgacgcctctgggtgggttcgaaccaccaaccttttagttaacagccaaacgcgctagccgattgcgccacagagacatggctgagctcctaatttcgttctataagagggtaagctgtcactaaacgctagctagcaccatccgccttttgcaaaatgactgggtaatctccaaagcctcggaaagccggagcagtcagagcgacgaatctacttgtttgtcaagtttgaaacctgtgcattgagtgattccgaaacgccccgcaccccgccttgcctgcctcagaagccggcgcttccggagatgccgggatcgcgactcctgttagagcgacttgggccccagggaagctgaaacgcccagggcgctcaattaggacttgttgaattaataatacatttgagagacagaatatacaatcgaacaatggccggactatacgtaaaaatataactctgatccacaacctggggccacctgcccaagaaatcaacttccttatgtacgaataaacaaccggggaagccagcctgctattatataagtcagactcacagggagccaggcagttatctgtagtaacaaacaataacatccataacaatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgacgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctagtcaattgatttccaagtgtgcaatgtcccatggggtaggccacaaagaggcctagagtgcaccatctgtgcggctgcagctcctggctctcaacagaactgagatctaagtcctcatgatctgatcagcttccaagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcctacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatatttttgcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacgtaatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcactgttctagaggctgggaaatccaagttcaaggtgccagcagactctgtgtctgatgagggctcactctctggttcataggctgtgccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagtggggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagtcttaacaaggcttaccttctttcttgtggtaattttttgataagcagtttttaattttgatgaaatccaattttcttattttttgtgacctctaagacatctttcctaccctatgattgtgaatatattttcctacattttcttccagaaacgtgtttttatttttatttttaaatctataattcttcttaatttcatctcctgatctcagcacaatgcttaaccactataaaatccacaacttgcagaccaacagttcaatctcccagaaacttgtataacccttgatgtaacaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcgatctttcttctgtaaaatggggctaataagagtagtcttaggccaggcgtggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggcggaggttgcagtgagctgagatcacaccactgcactccagcctgggcaacagagcaagactccatctcaaaaaaaaaaagaaagaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttctttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatttgtgtgtgtgtgtgtgtgtacatatgttttaaagtctcttggaagaatatctaggtgaagaattgctaggaaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtttccatttctaatactgaattgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattgctttagtaccttttttgaaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacagctcaataaacctgaaatgtgtacatcctatggtgccaccatgaaaatcaagacatgctgtcacttaatcgctctcatttcactagaggacacatgagctcatgaataacggttgaccccttagccaaagatcctctattgtaccctctggagaaaataaatctctagttaccttaaaagctgatctagaggtaaaatgtctgcaacattcagcaatgaatttagattatctttgaaaaaaagttcattttcaagttgttttttttgtttcgtttttttttttttttttttgccaaagaatttctttttttttctgttacttagtagcatgaagtacaatgtttggtttgcaatttctgttctttgtaggaagaaaaactttagtggaaacaaccagtacttaaagaccattttatgaggctgtcatttacgtattatctcttttgctgtttttgttaaaatgatataaggtgggctttatatgctttctgtatatcctttggaatgtgtatttaaattaaaaacttaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttcctcccacccttgaaagtcctcgacttaaaacccatctagaacatttcctttgctaagactttaaagtattctttcttcaagttaagggcagtttttaaatagttatcagttgcattcttggaattcacagaaagcttggggagaaacaatccaacggcacaagttcaagtgcccaacggggtggagaagggactgcatactcactggttgccaggccgaggttgtccgccttgcctgctttggctgagactggagacggaaactccattcaacagcgactggaggactgaaacagggcgcaagagggcggctgcccttcacctaccggtccctccctgccttggcgccttcggagttcggactgacccgggatgttgctggagcccgcaggaactgcaaactcaccgcgcgcgtccctgcacacccgcacctgcgcctcgagaactcctggccagttgaatacccggtcccccgccgagcttcgctgcaggtcacaggaaagaggtgcagggttgcgtacccggcgggagaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggatggagggagggaagaaagatgaaaaaatcaaccaaaaaaagaacatgatttcctaactaatcggatgtgggtcatgagagaaagacctgcgtcgagtttttggcctgaacgtgtggagggtggagttgccattaactaacgtgggaaaaggcaggtgtagtacgttttagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggcgcatctttaggtcggtagtgaggtgcggccgggacgctgcaactcgctccgggacttgtaaacctggcaggtgttcgaagagggccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtaatttctgctgaaacaattgaaggaggaaaaaaaaaaaagtatgtgctttgtggttccctggtagtctagtggctaaagtttggcgctttcaccgccgggactggttgattccagatcaggggactgggtctcggcctcactgtgaggtattgttctttcctgtgtttgccatctgccaccgctgtggctcaattattccaagactgctggagaaatggaattaatgtcgatcctaaaatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttggaaccaatgctagaaattatcagtcttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatagtctcatgggtatgcttgagactttaggcccttgggacacctggtgcacagaagggtcccaaaacccatctttggaagtgttggcagagtaaataggcaccagtaataaaggcaacggcgcctgaagacctaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttattggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatgtatacgtgtgtgtgtatatatatatataaccatatgtaatttcaaaaggtaaattaaatataatgggacagtgttggtaacctcttagatagtgtagggctaagatagctgaatttatggcatggtgttgtatacttcagatatctatgctgtaatattaaaatggcatttccttggcccactaaattgtccatttcctggcccaaaaagatacgcgaaaggagtgaaaatgggaagaaaatagccttttgaaggacttgcctaataaacttctcccttagcattacttggagtgacatcagaaaattggaatgaagtaattgtgtaatgtaaaaaagacaaattctctgctgtctttctcccccaatccttaataaacaaaggaggaaacctagactcaggttaggttttctcttcttattctttacataccaggacaagtactgagcttgtttgttactatatggggacttagtatattgtacaaaggggtgtggctattactatcccttttctaccagagcatcaaaactggtaacttggctggtgttaacgggagcttctaaccttgaattcccactccatgtgacttctttctggttctctcttctcagagaacttgcagccatcagattcatttggagaagtttgataaaggttactttacgcttagacagaagaaaaaaccctaaggtcttgaactgagccttatcctctgatacagtttactggaattccctccactgtggcacaagccctgctgtaaattgtgattatctataccttgtcagttttatctatgtatatatcttttacagtaatccccacatccaccagagaacctaggttattggcagaatgaggtttgggaattctggtcctctggccagacactatcagttagtactctgattccaccatttttgaaattatatacaacaaattttaagtattgtttattttggagagttcaggttaaaggaaatgaagactattattcagtattatttctgtaattttgtaattttaaccataacataggtttcttatcaaaacgtatggaagccagaaagcagtgaagcaacaatattttctccaaaacgaacaggccaaactttggcaggagtgacaaatctggcatgcaatggtggcttctatatcagaaatcaagtcttttactttgtgagagcacgagtttttagttttttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgccccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagatgcagtagagagacttctttcgttaaagtacctgagtcaggttgaggggaagagaagaattaggagcacaaagagagcaggcacaccacaggaagcacaactctgcaattgcttttggttttaagaggctgtccattcagtttttttgggttttttttttccttttcttgaaacggagttgcccaggctggagtgcagtggcatgatctcagctcactacaacctccacctcctgggttcaagcaattctcctgcctcagcctcccgagtagctgagattacaggctcctgccaccatgcctggctaatttttctatttttagtagagatgaggtttaaccatgttggccaagctggtctcgaacccctgacctcaggttatccacctgcctcggcctcccaaagtgctaggattacaggcatgagccaccatgcccagcctgtccattcagtttcaatgaactttaaacaacaaaaaatgccatttgggtggctggtttcagtcttccctgtcaatgctcagcctccaaatattcactaacacatagaacaataggaggactgttactctcctctcacacctactacttgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacacccataattccacagcatgacaccaaactggagttactagatgacaacccaagtggtgggttgctctgtcaagaaggggccaattttatattgcagctaggcagttacagtctgtagctgtaccattgaggggatcggggcaagatgcaaatttccatggcttaccagaaacaggtgagaaactgcctgctggtagcctgctgcaagacaaggaggcccccaaaagagatgagtaagaaatagtcttatgataatggctcacaagactacttcccttaccatggtccaggagggcatttggtcaaggtttgagtcatagtatggttgagccttgcctatgtaaagtttaagcaaagccattcccttgtaccttgtaccttgaagagagtttcattggatataatatccttaatttgcactttcttctttttaatgagtaaattgcattttattttattttattttattttattttattttattttattttattttttgagatggagtctcactctgtcgcccaggctggagtgcagtggcactatctcggctcactgcaagctccacctcccaggttcacgccattctcctgcctcagcctctggagtagctgggactacaggcacccgccaccatgcctggctaattttttgtatttttaatagagacggggtttcaccatgttagccaggatggtctcgatctcctgacctcatgatccacccaaggagtctctctccctccttgtgttctggtctgtgaatggctcacacttgaacttagtgtaggctcctagtgggaggagcaggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactggtggaagcctcagggcaaggccttcacttcccagtgacactgttcccaattccctccagcatgagctgagcctcctcaggctgtggttgtgcagcagacagggtgtgaggaaaccctgctcaaccctggttacccaggatggcactgagttctaaaaagcaaaggttatgtggtgaggggcctggctgaagacctggtgtggtacttttgtgagcagtggcaccaatagaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaaatacccaacgtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagctggccacccaaccctaatcttcttcttatgcaaatgggttttctactttactcgcaccatgttgtctgctccttactgtacacgtggttagaaaggaaaagggaagatggagccaccatgttgaacatgcctaccccccaggtagccttgtcctattggcacagccgccagcagtcacctgtgcaagcttccagcttgcttatctatgtctgcagctccattttacaggctgctttttgttagaaaagaaattatttggtggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgtcggccttgtaggtgtggggtatctctagcaccagaggatcattgaggttggggatgcagggcagtgagcagatggacaagagaacttttgacagtcaatgctggagaccactgagaccataggatgttgaagcagatgctgccattgctattgatattggggtgataaattttggttgtgaaagcaacctttgggggcttgaacaggcaatccataggaaagtggatggtcaggaagaaaacacctccttggcaaggactgtcattaattatcacccagaggccccgtggagcactgggcaggaggattcgtctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgcttttgtaacttgttccacagtgatgcctggagacctgagtatgttttatctttaaaatctaataatgttactaggatattgtcttgaagttgatcatcctggtttaatttttgctgccactttatgggctctttcaatgtgcctcatcacataagtaatgtcattttcatttttgtaaatcaagtctcctagattgttcacctgaaagcctgattctcctttagagaaaaaaatgctaaaaaacaaaacaaaacaacaaaaaaaacaaaacattatatatcgcattacaattttattcaacaaatacagaggtttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggagagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaattaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttcctcgctccatagtgaggcgtgacccagcggtcagcccaaggtctagcatgcgaatcagggacgtgatggttctttgggattctagggatctacctggagaatagatgaaagtaacaaaagttttacataccaatattcaaaactgcatcaaactaccagaaacacttgccactttcaaagatagactatgctaagtagctccaggtgtgtgccaccatgcctggcaaatttttgtatttttagtagagactgggtttcaccatgttggccaggctagtctcaaactcctgacctcaggtgatccacctgccttgacctgccaaagtgctgggattacaggaatggctcttgactctaactgcaaggtccctagatcattagatcatttcctgaatatcttatgcttcaggcattggccatcacttgggttaccattgtcataaatcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccacaaatccggctcttatgtgtggtcctggagaaacaattgaaatacaatactgaaaaagacagaaattgttccaaaagaagctttttgcagtattgactaaaagctaacagtagacatccaaaaccaaggtttttacagaatacttttactagacaaaactataaatattaaaatagcttatttgatcaaactttaattccgaaaaaggctccttccaactgcgtaacagactcctatagaaaaacatcagaaattcatccaggttccttgtttctgatcctaaatcttcaatttaggacctcaacctcaaactgttgctttagtggctctgggaaggaagcactaactggcagcataggtaagtaaagttttaatctagggaagaaataagaagcagaatcagaattagaattagaagaaagagggaatatgctataccagaatatcataggcaaaaaaagaagacaaagaaagaggaaatgaaaggacagaaggtaatgctaatggagttagttatttgtggccgttttttgtaaaagagtaatgatcagtcttgtaatcattataatactattatttgctttctaaaatgtctaaaatatttgaaggaatttatgatataaaaagatgaataatgcttgcagtcagtgtttcattgtttgggagaacccagtttcctcagttaatacactttcgtgtaatagctgtttaaggagtaacatggtttaaagacatattaatggctgaaatattaacatattggtcttttgatgaagttcaaatagagagatttctttccccaattttccctggaaagattaaactgaagagaaaaatctggaaagtttgccccacatgttgggtctgggagtcattatgattttttcaaagacaggagttgtgtatgacatggaatcatgcttcttctctagttgagaagccaagctaggtccaggctgagtcataaacttgaacccaacaaggaaatcacccttcacactggccttgcagagctttggctcaatctgttctctgcccaacacccaagacacatactagttctggccaacaaaccttcacatattgtctgtgtcaaccagagctacatttattccgaaatctctttctaaaatacaaacctgtactttctactctcaaccccaaaatttacaagaggcctcatatgcatctcagagtcacagatgctaaaactcaacacaccagtgagttccctgtcagcatcatatactaccctctacctcaatgatcagccccaagccagcatctcccaaagagtagtgtgttgctgtgggtgtttcaacagatcactaaaacctgcttctacccctgcctagacacttatcctcactgctatgcatcctgctcctcaaatcagatcttgatatcttctttaaacactcccaatctcccaacacgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtatcctgagtgacctttccacagtgtaaatctggacatacctgtagccttaaatcatatctaccaacatagtagccaagcaacagcaatctcttttcctttggtcattagagtcctagagaccaagaggatgttgggaaaagaattaccatggatcagctctcagaggcagtaggttctggactcatgctggctttgatacgtgtgcattggaaaagctcaagtacctggcaatacttggagattaggaagaaaggatgaaaataaaccactgcactaaataacatgacaataatcacttatacaaaaattttaaagataaggaatatttaaagatttattagtttattatagctttatagttggagagtgaagaagaaaataccaaagctttttgtcttaacaaaatggtgcagacagattaacatatattgtcacctatgataaccagtcagcataaaaagtatttagaaaggaatggttatattctctaagagatatattctgatgtcatgttttttgctttagagtctattaatatagccacctttttgttaatgttttcagtcaagctccttttctcgcctttcatttccaacctttctctcactttctggtttagatacaactcctaaatatatcatatagttaatttaaaaatccagtgtagcagtatttcgggggtttgttttactggataatttggtccacttacatttaatgtaattgttgatatatattaattttaaatctaccatctttatttttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatccttaatttttttttttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtaataattgataccgttatcctcttcctgcacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttactctttatttctgctatgtctctgaatttccatatgtaatcatggtccttctgcctgagaaacatcatttagaatttccttttgtgttggtctgcttgtgaaaaactgtttcagctatttttctctgaaagtgtctttatttgctttaattattggagattatttttactaagtatgtaattctggaggcagttattttctttcagcatattgaagatatttacatttgattgtttcttttcagaaggcagccaattgtctcgctgctgcttatttgaatgtaatgttcctttttttcctctgttttttgtctttactatttttgtctttgtttttttttttttattgtctgcagttttactactctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaagtagactttctcactctatttgttatatttttgtgtttgtgtattaaatattattttttctccttgttatatattctgaatttttttcttcttcctcatctcccactttactagttctcttttcagctgtgactgctctcctgttaaactcttccattgagctcttaattttgttttgtttttttttttccgaatttctgtttgcctctctctaaatctattctgtcatttttttgttgtttccaattggtgtgtaaattgttaacaaaacccttttctccttctgcatgataatttgaccttaattaactttccagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctgatagcaagctataattcttatcctacatctctcggattaatctggtgccaagtatggcctctgagattcttgtgagcctgaacgttaacttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagttcatttttatcccaagattatagaaatgtaaggtcctaccttattgtaggattattctcctgataaactccccaacttgggcagactctggtcttctatttctgtcccattagtcacagaaggctgtcaaaccctaatatgcaggtcaggaaatgtccttagccaaaaaatggcttctctgcttgcttacggctctgggttccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgttcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatttgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactatgctgccaaagtgactcaaactcaaaaggacaggatgagacttactcagaacttcgaggaagtgtagagaaattatccaccactttttatcctagaggtgcttttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaagagtcaagtctatgacttacaagcttataaagatccctcagatgagttatgtacatggattgagaatcagaaaaggaaggatgctctctcaggagatagaaaaaccagataaaaggaacaactgaaattatctgacccatcccctcatcgcctgtgtagaagggaaatgcttactttatctaaccagtggataacagacagcctctttcattttggagctaccaaaaagaaaaataaattgtggtttggttcagttcccttttgaccagtatgttcttgaaatttcgaaaacattttactctttttccttttagtgtttcagtgtggataatttcatttgatctattttcaagttcattttttaggccaaaatttgtcaaatattggcaatttcatatgattcaacttaatatattaacctaatgtgccaaattcaaatttgtttctatactactaaataatatcccccgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttatttaagctttatatatttactttttacctgttaattgttgtaatcacccactaaagagtaaattctggctgggcacagtagcttacgcctataatcccagcactttggaaggcccaggtgaatggatcacttgaggccaggagtttgagaccagcctggccaacatggtgaaaccccatctctactacaaataaaaaaattagctgggcatggtgatgcacacctgtgatcccagctacgcaggagactgagacacaataaacgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtatcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatgtaggaggatgtgtatgaatgagcatgtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcctttcttacaatcccggagccagcctcatggccccctctcaaaggcatgagcatcagccagtggacacctcttcttcagagatctgagtccctgcgacactaggtacttcctctgagttccaaggccaccagcaacctccttctcagaagccatcctcccagttatgtgtggcccttcatccaagttaccaagttctaacaacccaaccattttacctttgtttctacaaccctagggttgatcactgcttcgctttctacacttactatctctgtgttacatcagttccccttttgccttcttagacctccaatacctgtataattccttgtgttaaattccctctggtatactgttcattttctatttttttttttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgatcctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaagagacttgattaactcacagttcagcatggctggggagccctcaggaaacttacaatcatgacagaaggagatgcaaatacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttcccaaaagtcccccaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagagattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactatcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagatcttgtcctctgcacacctgcaggaccaacaccatgtgaaagctgccaaggcttggggctcgcacccgctgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagacactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagactgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaaaccccttataaaaccatcagatctcgtgagaatcattcactatcatgagaacagcatgaaggtaactggccccatgattcacctacctcccactgggtccctcccatgacatgtggggattatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttgtaaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaaagaaatgaaaaagcaggaacacatgatagggtagtctgagctctgtacaaataggaacagtaacatagacaaggagtaattagagtaggctgaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaacattattgaatttttatctaaatgtgatggaggatggacaggaagagaattactgattactctcagtcaggattcatcctagcagcaattatttgtaatttaactgaaataagtccatttgactgaagagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaattgttatacacccttcctcacagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattattttattttattttattttattttattttattttattttattttattttattttttgagatggagtcttgctctatcacccaggctggagtgcagtggcacaatctcaactcactgcaacctctgcctcccgtgtttaagcaattctcctgcctcagcctcctgagtagctgggactacagatgcatgccaccacactcagctaattttttgtatttctaatagagatgaggtttcgtcatgttggccaggctggtcttgaactcctggcctcaagtgatcctcctgcctcagcctcccaaagtgctaggattacaggcattagccaccgtgcccagcaattcttttggaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagactgccatgtaggaaacaggatgtctctaaagtgaaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacaaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtacaacatctgctactcctaccaaatgctaagccactatgaggatataatgctttatttttatttatttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgtttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacaggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacgtgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcgcagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaaatttttttcaaggaatagaaccactgcacatgctcctcctgatcccccaaagtgtaagattttcatgcaaatagctatctcccaggacttacattagtaaggtatctggatataaaaatcagtgttccctaaatcagctgtgtttccattatatcaaaaataaacttttagaaattaccatttgaattaacaaagatacacacacacacacacacacacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatcatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagaaatagacaaaagtgcccactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttcaggccatgatgggaagggggagctgaacatgcctcatcataccctcctcccttttggaattactggtagaacagactctaagtctgataaaaaaaaaaaaacatttacaatctattctctctgaagtctgctgcctggatacctggaggcttcatctgaatgacaaaaccttcgtctccacaaccccttatcacaagccagatattcctttctattgataataaggaattgccaatcagaaaatctttgaatctgcctatgacttggaagccacctcacccctgcctgctgcttccagttgtcctgcctttccaaactgaaccaatgtaccttttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcacatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcagtaccttttaaagatgttgttgctacattgtcttctcacttgcattatttccaacaagaaatctgatgttttctttgtgcctctgtgtgtagcatgtctttttatctccgatcacttttgagattttctctcactaactttcagtaatttgattattaaatctttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagatagattaacaagagaaaagcagataatcagggaaaaatgagtaactctcaaagaggtggcctagaattttggcttatgtagcatcttcaactaaaagaaagaaagaagggtgttgggaaagcaagctatgggaaagtgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactccgagagggttcttggatctcatgcaaggaagaagttggagtgagtccatagagtaaagtgaaagcaagtttatttaagaaagtaaagaaataaagaatgactactccataggcagaccagccccaagggttactggttggctatttttgtggttatttcttgattatatgctaaacaagggttggattattattcctttccaggaaagggggggtgcaattccaggaactgacagttcctcctctttttagaccatatagtgtaatttcctgatgttgccatagcacttgtaaactgtcatggtgctggtgggagtgtcttttaacatgctaatggttataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcatttttttttaaccctctgtttcattttggattgtttctattgctctgtctttgcattcattaatcttgttttctgtggtctaatgtgctctcaatcccatccagcatactggtattcatctctagaagttggcttttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacatgcacctgtgaaattaaaaaaaaaaagaagaagaaactttttatctgaggaatgtgagcccctttaaattatcaggctcggagaggcattggaatgaaactgcagtcacatcactcccccttgagtgattatcttgtaaagccacttgctatacgggctccagactaactgatgccaagcagccataaaataccatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtaggtgaggcaattgcagggctcatcttttttcttccctatctctcaggggtgactgtcttttgttgcctgatgtccacagtttcaaaaaacattgtttcatgtattttgttcttttgtttaattttgtttaattttgtttcaggtgagaggataaatccagtctctgctactccatcttggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatacactaagtgagggtctttcagaatagcgcttcagtgtctgcacctgactcacactattaggcagttaaaagctggggaatgagctcatgtgaagagtttttccatttcagatgatagctatttttaggaacacaagctacataaatgttttaacccttttcccatccttttcctcttgctgctgtgatacaggaagaaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacatattcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaactcctgggctcaagcaatccacacaccttggcctcccaaagtgttgggattacaggcatgagccactgcacccagcctatctcatcttttaaaaaaaacatatcaaataattgttcataaatcattttctgtagtagagagcaatttttcttaaaattggcaaataagattttgcatctacctttgagaaaattgtatttgtaaagtgattttaaaagaatgaagcctatgagtatgatggcattataaaagtatcagtggccaggcgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaagtattaatatatggaaatacaaatgtcatatatagatgtaaattctcctaattgttcttctgagcatcatgatttttttccatgaatttttattttaagttccagggtacatgcgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcatggggtgggcactgttatactccatcagtgagtacgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagtgatgaggataatgatcatagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgctcgtatagcaatcctcaaatctcagtagcatataaaggtaagcatttagttctcacttacaagtttgcagggcaggtgaggcagctctgcctcaagccacaatgtctaggacagctctgtttcgcactgtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacataccctcatgaggctgtggagagagtgtagattcagggagcggtgagaaactggggccagtacaccaacttacagcatgatttgtcatcatttttcattctctgctagtaagattgccaaagtctctctgcactcattgaattcatttagctctctttagctctctttttttagctctcatttagtttccatttagctctctttctctcttaccacaatacctaaaaatctttttatggggttacaactctgtctcaggagccacctcagtttggtggcacagagctccccacttgtactctgaaactcttttcttgaagatattgctatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagaaacttctggattcaaatgattgtttggaggcattagccaggcattgaaccaattataaagagtgaggttttgccatattctaaccgtaagaaacagaaacggtagagggtaaaaatagaatagaatgtcaatacaactttagccttttccctggattctgagagttcataacctgaaaatcagagattcaaactgggagagatgggctaacaggtatgagcatgggaaaagcatgtttcaagaatttgagatgtatttcccagaaaagcaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggcgccacactgtggccgcatgtgcatattgcagcctccgcctgtatctgggggccgcagccgccagcgcccggggacccagctgcggcgaaagctgttgggcgcgcgcttctccgcagctccgcgcccccgccaaaacccagtgagaaattatttgcattcctggaggctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgccagctcccgggccccggcgcggcgccacctggcggccgtctgtggaggttgcagctgccgccaagccccggggatgctgccggcctcaggtgcgcccggccgagcctccgcggagaggaggattggtagatcacaggaaacgggaggacggcgctgggctcccagcaggcgccccattttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgaggccctggagggatctgatgcagctggcggggagaaaggtgggtcggacttagaggggtggtggggtggaggaatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttaggggtcgttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaagagttgggtccattctggatctttcctagctaaatgccttcaggatttaggaatattttcctaggagggccaaggattagctagacctgcccagcgattccagccctgagaaccagacagaatggaggtatagctgacagctggctgggagggggctgacggtcctcactgccaccaggcttagttggagacagattcctcgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgagacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggactgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaataaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccatgcgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacaaataaaattgcttgctgtccttctctctttattctccacttcttgttttttctaaatgtggggtcaaaacttccatgagggtaagaagttcagttttctgcctttccccttcatctccctatcacacatgtatactactcaacacttagagaagattaaaaaaagaataaattgtggagagggagcatatgtgaaagtaaaagattcccagacataatatgggagttaatggagaaagaaaatctctaaggaagactagaaataattgggttagggattctcgagaagtaaattaaattccccaaatgtggtattctctgagaagataattttgaagaagcaatggcgtgatatccagtgaaacagcagtcctctggagcctggctgtgacttcaaggcccagttcttctggaagggcagaaaaatacttcgaagaggagaaatgagcatttatataggtttataagtaccatctttattttagaaaataatcattttctaccttgaattctagtttattgtgaccaaagattgtaaaatttcaggatatggctgaattaaaatcttggtcctgcacttaagtagctccttgaattgcaatttcttatcccaattattttatcctttcattccactgtgaaatctatatcatggcacttaatagtcaactttattattttaacaaatgcttatttacctttcatgggttatttcatttagccttcataatatctgttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcagtggcactatctcagctaactgcaacctccatctcccaggttcaagtgattctcctgcctcagcctcccaagtagctggaattataggcacacgccaccacacccggctaatttttgtatttttagtagagacgaggtttcaccatcttggctaggctggtctcaaactcttgacttcaaataattcacccacctcgccctcccaaagtgctgggattacaggcatgagctgccgcacctggccttggtgctatttttaaggatatgtatatctgattttttttctgtttctcttattctttaattctgttaattctttattcaggtattttacttttcttagctcaactttggtaatttgtatggaaaagtcaacattttgtctacattcgcaaatatatatcaaaaatacacatcattttaatatcttctatatctagtattacttatgtgctttttcaatagtaagtttacggaaggattaactcttaattttcttttcagggaacacggtgtttggttttataaattccattttggtggaataggaaggtatgatctgtttcattgactatgctttcatcttactttatgccttctactttccacaggtttttgttgtgttcctttgttagcgtttgagttaaaaacttaattctctctctgttgctcaggctggagtgcagtggcatgatctcaactcactgtaaccctccgcctcccaggctcaacgatcctcctgcctcggcctccctagcagttcgaactataggcgtgcaccacgacatccagctaatttttgtatctgttggagacacagggtcctgccatgttgtccaggctggtctccaattccagaggcaataattgggaggccaaggcgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagtgtataatttttattctgatatcccctttaacccatgtgctttttcctaagagtacaacttaaggagggcatgtttgattattttattgttttataatcagttaactatgccctggtcctatatggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcagtaagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgactttaaaaaaaaaaaaaaaagaggaacttgctctgtcaccaggccagagtgcaaaggtgcaatcatagctcactgcagccttgacctcctaggctcaagcaatcctcctgcttcagcctcctaagtagctgggactacaggtgcatgtaaccatgcctggctaatatttttactttttgtagagacaggggtcttgctttgttgcccaggctgatcttgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatgtgtttagaaatttctctttgttcccaaattttgtcactgtgaatctaggtgagggtccttctcatcatgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatttgtattttatttcttacatgttttcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggacggagaaactcaaactatgtgtttcctgtgctttcacactacaacaatcaacacagaagactgacggcggaggggggttctccatacagcaagcaagcaatcagttctgcagtggacaccagctgagtgtactccaattcaatttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggtaaagtatgggggaaggagcatggagcttccatgcacctccactgggtgcgccgcccttcaggaacctctacatgttcagctatccagaagctctccaagccctgtccttttgggtctttgtatggaggctccattgcataagaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagaccagcctgggcaaaatggtgaaaccccatctctataaaaaatacaaaaattagttggttgcggtggtacatgcctgtggtcccaactactagggaggctgaggtgggaggagagcttgagcccaggaggttggggctgcagtgagttgagatcgtgccactgcactccagcatgggtaatagagtgagacccggtctctagaaaataaataaaaagacttcagtcaccaaggtaaggagatgggtggatattcctactgtggtacctgaactgtcatcctgtcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagatgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcataggttatttcctcatgccaggaagaacagtcacagttctgtttcattacgcttctatctttgagactcaaattcccccctccccactataaattatttgcacatactagtctagaaaaatttaatatgccactttcccccacaaacacatctccacaatcataaacaccatgaaataaacttctcttagacaaatgaaaaagtttcttacctttttctccaggctaaggatcaaaattcaagttttacttggttaactctcctgctaatctgaaaactgtcttctactctatagatgcttgctgtttcaggggggcaggcgggagttatttaagaataatttccattacctaataccttgatactaatgtgaaaaaaattatgaaaatcagaggtcaaacacttaaaaagatccatgaaaaatctcctacaaagacacttaaataagtaaaatcatcaaattttcataatgtgacagggagaagattgaagaaaccaaaaaaagcaagtatgttcctttgctggaactaatcctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagagttctccagagggacaaaactaataggggagacatatatctatagatatagatagatgataatagattagatacagatatattaaaaggagtttatgaaggagaattggctcacatgattacaaggcaaagtcctacagtgggccgtctgcaagctgaggaagaaagaagccagtagtggttcagtctgagtccaaaagcctcaagagtagggaagcccacagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccaccttctctctcctgctttgttgtagctaccctggcagccgactggatggtgccaacccacattgagggtgagtcttcctctcctagtccactgactcaaatgttaatctcctctggtaacaccctcacagacacacccagaaacaatacttagctatctaggcatcctttaatcctatcaagttgacacctaatattaaccatcacaccctaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggtaatttgcagttattgtcctttgatcatgtaaagcaactgagatcatttgctcctgacctcacgtcactaatctatatccttcattttttgctccaagtgttccttcttctgagtgcctagtgctgctccagtacctagatatctctctctccccctctctttctgtctcaatatccaatcaatcccaagctgtattagctctttaccaactttgggaaagtggaccagtatccaggcttggataaaccaaggaaaaatactaaggaactgcttaaagctctagtggttcttctactttgctgtttctggctttggccatctaaagcaaagttccttggattggttgacagtgagatagtctctagattcttgtgtctctttttagtaggaccacctaagatgtatcatccattgtataatgagttcttgaccaaagaaaagaaatcttaaggtcttcggactctgtcatctttcttgtttgccactctttggactgtaatttgaagagaaaaaaccttgttttcttgtgaaaattttggatgctgagtagttgacaacaacagtaacttcagctagaaaatgctggaaacaatttaataagcagaaatgattaaatccaaaatcatcaacatgactccaccaaccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtctcatttcctaatttattattttcctaatgggccacatagcagacactgaaggttctacataacaaaggtcctacaagtaaattgtgaaaatcccttattggatggtgtttttagaatacagaaggtcttatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacaacactgatcaaatatttaccatgttccagccactgtactaagtgctttgggtacattacctcatttaatcttcatatcaagcctagaaggtagtttccattatgttttccactttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagccttcagcatgatatgtgatcatgtgagagccacgttatgtgtattctttttaccacctcttctgtatccatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtcttatagtgttccataaagtgatgggactataattgtccatcttcaagtatccttctatgactcatgtataatcccttgacttttaggagattcctggcagttaatgtcaatactgcccttcataatgcttctgagttagcttaggtaaggtccttaaatacccaatgacttatactctgaggcttctaaactggtatgtggacctcggtggttgcaacttcacccaaatcctcattctgtgttgtgctgtccctaatttagagggcaaaagatttcaaactcaatcatttcttgttaaattcaactcttggagctccacctgtcataaacacaatcccatttcccatgtactcagttacttctgtttcttgaatccatcattcatcccatagatattgagtgcctaatgtattccagatatagttctacataatagggatagagcggtgtatgaaacaaagcacctaccttcataggacttattctgaggaggtaggaggggagacaaatgatataataacttggactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggcaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaatacattagtattcagatggtatatggagaataattaagaaagttatgagaggccgggcgcactggctcacacctataatcccagcactttgggaggccgaggtgggtggatcacaaggtcaggagatcgagaccatcctaacacagtgaaaccccgtctctactaaaaatacaaaaaattagctgggtatggtggcacttgcctgtagtcccagctactcgggaggctgaagcaggagaatcgcttgaacccaggaggtggaggttgcagtgagccgagattgcaccactgcactccagcctggacaacagagcgagacgcgagactccgtctcaaaaaaaaaaaaagttatgagataaggaataccaagaagtgaggaaagaaaaggaggggagcttgttatcttacctaagatgttcagggaagacctcaatgacagttggtaaagtaacttctgagcaaaagcttacaagaaattaggaagccagtcatgcaagtatctagggatgagcctttgagaaaaggaaatagcaagtgcaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggaaggagagagcagaatcaaggaggccatttaaaatgccattgcaaatatccaagagaggtggaagcttggagcagggaaacagtggtggaggtggtgagatgtggttggatgctggacatattttgagccaagaggattgtctgataaattgcgtttggaaaataagaaaaagcttattcactcaccagcctaatagtcacaccaatctataatcccagcactttgggaagccaaggcaggtggatcacttgaatccaggagttcaagaccaacctgagcaacatagtgagaccccatctctacaaaaacaaaaactctaaaaattagccaagcatgtggcatgcacctgtagtcccagctactcaggaagctgaggtgggatgatcacttgagcctgggaggtcaaggctgcaatgaactgtaatcatgccactgcactccagactgggtgacagagcaagaccctgtctgggaaaagaaaaaggcatggcggggggggggggggcgggcatggtggtacacacctgtaatcccagcactttgggaggctgaggcaggcagatcacctgaggttgggagttcgagaccagcctggccaacatggtgaaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagattccatctcgaaagaaagaagaaagaaagagagagagagagagaaagagagaaaagaaagaataatcacaccccaagaaaatcaagctaggaccatggtgagcaatgctccaagagtgttctgatgctgtaaactgagtatgatgtgcataaattgttttgcactctgcaggtaggagggtgggatagccaaagctgttcaatataataatattaaaaaataaaatctcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttttcaaaataaaatggattaacataaaaaattattaaagagataaactaaaggaaaatattacaacctggctgaggggcaaaaattttatgttcaacatatatttgataatacatactgagaaaacacggtctacttttacttttcaaaagtttgttcatgttgacattgtggggcctagaagatttttatcaagttttctatttttgccaagtcatatgatctgctatagttcagctatagttaatcaaatgtagaaaagaaaaaaattttccataatatctagtaattctccaaaacaagcttgttcctagttaaacactgacattctttggtaactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttaaaaagctacacaattattcgttatgcaaggaatgaggccttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactaccgcaaaacgggctggttatgcgctacttatagagcccgtatgcaaatgaagactcgcaaagtgctgcgctttcattggttaacttacaacggtgtcgtcagagggggtggagtctatgtaaataatagattctagtcttgcttccttaatggtcactgtaacaaaagtcttgttatcctatcagaatggtccatttcacactaaccagttttaagctaggtgaagcgatagtttctacggcttggggttttttcttggttttcactttccattagacttgcatacggaagaaatcttaacgccagctagacaagttaactctcttgcctcgtttttgcatttttattctatactttgtggaaatttttttctcttccttgaaatactacctcacccatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaacgctcggccggaaccacaaggaccatgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgataggagagggtctaggcagtcatatttatagacatagtctcctcttgattgggcctgaaaaggaaattttcaaacttgtgatctcattggttaaaattcaatcctctttactggggcggaagattgttctgctaatctttcttcccttattatttccccctttcctgatttttttctgtaattttatcgatcacggattgtttttgaagactttcctttaaattagtctaacttttgtaaaagcaatgtataaagtgttttgcatcccattttaacagagattttttttttccccgaattcaagcatgcccttctatgagctatcagcctgtttcaggttacctgttactgtagctcttctaccatagctaacatttatttcatgtctggcattttgctcagcaagttagatgcattgtataccatgaatgaccgaagcttagcaaaaaaatatgtaattgaaggaatgaaaaaattgatcttatttacttgaccttggaacccagccaaagccatttcatgtgggtagtgtgctgacctatattgacctgatattagagcctctgccttcctttagtcttttctccctgcgatgtggttccttcttcctcaacctcacatcaatggccaattaggtcctgcagatgttaagcttctaaatcaaagaaggacaacaccagaaattcatttctcctttacaatgtagaatagtttgtaaattagtgcttattagccagattacaagttcaagtttcaaagcaaattattcatcaattgctgacttgctaacattttattcaataaagtattttataatgcttaaaagtttagttttttttctgttctctatgaagagagtaaagatgctttgctttttcaatttcatgtgctttgaagtatgtattgttcagaacagtaaatatcatagtggttatgtagaagcaactgatacttaaaagttgtagtagttaatataaaacttttaatcatatccttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatgttactcttctcactttacagataagaaaactgagtctcagagaaattatggcttgtcctgggtaagtaacaaagcctgtgtaatattctaaagcaaaagaatgaaactgtaatgatgaaactttctatttcattaggcttagaggatacctttttttttttttttcatttgagatggagtctcactctgtcacccaggctggagtgcagtggtaggatctctgctcactgcagcctctgcctcctgtgttcaagcaattctcctgtctcagcctcctgagcagctgggactataggcgcaagccaccacccccagctaatttatttatttatttgtatttttagtagagacacggtttcaccatattggtcaggctggtctcgaactcctgacctcaggtgatccaccctcctcggcctcccaaagtgcttgggttgcaggcatgagccccacgcacccagccaacacagtttaaagcacaaaagcgttttcccatcaagcaatcacatcatctagtatttctcaaacatctacacccaactattcccattagaagggaaaactaccccatggaatctggatgatagcccaaagcagcccacccaagcatcacatttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcaactttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagaaggcaaaagaaaatattaataaatgaattattacgcacataatgttttgtatgtacatgtgtttacttttaatacaaaagtaacggactaagttaacatagatgttccaataagataatttatgtttcatttttggcttcaagtatcctcagggttataagtatcataagctgagaccagctgaattggtttgtgggttgatgaggccctatgcctgatttgaatttctcttgaatggtctgcagccctggaccaagttgaagaagccatgagagtctcagcttttttccttaccccattatgagataaactcattccttaaatatcttgctcatttgataaaacttggcacctttctcctttctactggtccctaatacttactacctgtactgtaagctcaaattttttgcaatttctgcctttattatgtaacgtattccactggaatatgtgttacaggaaaggggtcccgatccagacccctagagagggttcttggatatccagcaagaaggaattcagggccagtccataaagtgaaaacaagtttactaggaaagtagaggaataaaagaatggctactccatagagagaacagccctgagggctgctggttgcccatttttatggttatttcttgattatatgttaaacaggggtgggggggtggaccacgcctataatcccagctactccagaggctgagacaagatcatttgaaccccggaggcagaggttgcagtaagctgacatcgctccactgcactccagcctggaccacccagggataatccgtcccccgcaccccgcccccccaaaaaaatcactgccagtaaggaacaaacagccaggacgaagtactaagatgtaaagagatgtaaaatagcccgggcgcggtggctcacgcctgtaatcccagctctttgggaggcctaggcgggcagatcacgaggtcagaagatagagacgatcctggctaacacggtgaaaccccgtctccactgaaaatatttttttaaaaaaaattagccaggcgtggtggagggcgcctgtagtcccagctaatcgggaggctgaggcaggagaatggcattaacctgggaggcggagcttcaagtgaacccagatcgcgccacggcactccagcctgggtgacagtacgagactgtgcctccaaaaaaaaaaaaaaaaaaagaaagatgtaaaataatgtgatacattctgcaagagttatgacagagtcagaaaggggcaagcatgtttcttctctaccctgaagcagccaagggagaagaagatatctgttgccaacgctggggtgttacaagtgcacactgccatgcccggctaattttttggattttagtagagacaaggtttcactgtgttgcccaggctggtctcgaactcctgagctcaggcaatccacccgcctaggcctcacaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtgtaagtatgtccatttacagattgggagatggaggaatcacagagcggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgtgcgcctgtagtctgagctacttgggaggctgaggtgggaggatcgcttgagcctgggagattgaggctgcagtctgcagtgagttatgatcacaccactgcactccagcctgggcaacagagaccctgtcttaaaaacaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacgaggaaaattagagttatcaatgattttgggggatgagtggagtgtagttttcataggctcaaagcaaagcagggctgtgtgaaagggtaggcataggatgggactttgcagtggatccagggtcttgtttcctcagaaactacaacgttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggagaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttatttcccccccctttaatctatattttattttatttattttttacttttttgagacggactctcgctctgtccccagggtggagtgcagtggtgcgatctcagctcactgcaacctctgtctcctgggttcaagcgattctcctgcctcattctcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggtcttcccaagtgctgggattacaggcatgagacaccgcgcctggcctaatctatattttaaaaattgaactcttccatgtacccctgaacctaaaataaaagttaaaaacaaacaaacatacaaaacaacaacaacgacaaaaaaaaaaaaaaaaaaaaaaccaggccgggcatcgtggctcacgcttgtaatcccagcactttggaaggccgaggcgcgcagatcacgaggtcaggagttcgagaccagcttgactaacatggtgaaaccccgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaaaaaaaaagagagagaattctgtactttgtaattagaggggtaattcattaattcatgtcaggggcatattattttatttttccaaatgctaggaagcaggtatccattttttgataatataaattttgggataattggcagtcatctggctcacagggaaaacaggaaaaacaagaaacctaaataaacttcatattgatttcccaaaaaaattaccttttattttcaacccttatagaactcaacctgcatctctttgccatccatgttctttttttttagagactgggcctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccgcattttatctccccactttcccagcaatggacaactaggcttgtgccaattctccatcaccaccagaaatgctgcaatgaacattgttgtatatattcccttttggacctatataagaatttcttttggataaaaactcaggaacagaagtgctgagaagccagaaaccagcagttctgttcagagttttatttacatctaattgaactaaggagtgtcaggctcccctccagaatgcttgtcccggacttccaataccaaggtagctggactctgagcccacatccaggcccagtcctcgggtcatccaactttctaagttttgccagactgcctggtgtaaagtggtatctcagcattgctttcgttttcattgttccgggtattcatgagttcaagcatctctacctgagcttgatagttttcggatttcttctcctgtgtattgcctgttcatatcctttgctccaacattgtttatagagcactccctccctactttggcatttggggtcccctaaactggcccccattgctaaagcttacttctcatgactgacctttgcccatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattttttatttatttatttattatttttttgagacgaagtcttgctcttgtccccgaggctggagtgcaatggcacgatcttggctcactgcaaactccgcctcccgggttcaagtgattctcctgcctcagcctcctgagtagctgggattacaggtgcctgccaccatgcccgactactttttgtatttttagtagagacggggtttcaccatgttggccagactggtctcaaactcctgacctcaggggatccgcccccctcggcctcccgaagtgctgggattacaggcgtgagcgaccgcgccaggcctcaacctacatttcaagtcaccatctgtcacaggataccttccactctggctctggatatgggggtcacctcctcacaaagacagacaggctgtatgtgcatacacagaaagattcagaagaaacatgaagacttttaaaatcagtgagatgattttaactttctttaaatcagtgagatgattttaactttcttctttgtagttttctctagccagttttaaaaactgtaagttgtaggccgggcgcggtcactcacacctgtaatcccagcactttgggaggctgaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgaggcaggagaatcccttgaacccagaaggcagagcttgcagtgagctgagattgcgccactgcactccagcctgggcgatagagcgagactccatctcaaaaaaaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgttgttgagacggagtctcactctgtcgcccaggctggagtgcagtggcagatcttggctcactgcaagctccgcctcccgggttcacgccattctcctgcctcagcctcccgagtagctgggactacaggcgcccgccacccatgcctggctacttttttttaattttttttttttttttgtatttttagtagagacgggttttcaccgtgttaaccaggatggtctcgatctcctgacctcgtgatccgcccgcctcggcctcccaaaatgctgggattataggcgtgagccccagcgcccggccaatgtaaatgtatttcttactgtagacttgaggtcaggagagtgggctgtactggacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaacatagggaaaaagccttttcttctttccagggttgttgtggactcaaacgagaggctgttagtgaaaggtttttgtgagttatgaagctcctaggaacccaattatttctgctgccttggccacatagtctagaagaatctctacataattagcatctagagactagataatttacccattattttccatgtgcttgtcttatttcccagcatgacggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgtccaaccattcaggcttttcattattataggaagcatctggccaaggaccaccaccatcttcctgtcctgcccctgaagctgtgagttccccaagtggagacacagcctgttccccaacacctacactcatgaacatgggagggttggtcaaaattgcacagctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaactaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctccctttttttttttttttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgccggctaatttttgtatttttagtagagacggggtttcaccatgttggttaggctggtctcaaactcctgacctcaagtgatccagccgcctcggcctcccaaattgccgggattacaggcatgagccgccgcgcctggccttgctttttctcttttaaaattactgttactcatggggtatctgcaggcctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattagggatgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtccacttgcaaagacgacagatctctctacaaattctgggctgagcaggtgaaggaggctggtcaggcccatgaaggagcctagtcagccgtaaggaaaggttcactgtggggcccccgactttccattcctgatctcctttttacctctgctgcccacttcctttcctctttccctccaagtataccttatactctgctcctgatgacactcagatctccccccgcccccccgcccccatcaaatataaagagcctagtgacttttgtaagaacggtgtattcatttcctagtgttgcattaataagttaccataaacttagtggtttaaaacaacacaaatttgccgggtgtggtggctcacgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactccgtctcaaaaaaaaaaaaaaaaaaacatgaaaccaaacaaaacgaaaaaaaccacacagatttattctcttaccattctggaggtcagaagcccaaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagattccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccctcttctcgggccaacctggaggaagttccttccagagtccaggctatacttgcttctggcctgcaaattcccgagaattctttgaaacctaggaggggcctgggtattatgccgttttgagtgagaattcagaggccagtggaattagggcaatcaggcatttcctgatcatctgctatgctccaggatgctgacttgaagagatgaacaaggcaaaatgcccattctgacggcactcagaatttcacggggaactggaaggataaatgaatctgggaggaactgctaaaacaggtaggagagggtaagcttgttagaacctgagaagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcccagtctgtaaagtgagaatgataaaacatctgccttccttgcaggattgttgtggtgatgtgtaagacaaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatcagagtaataacaactggtggatgtgttctcctaggtagagaacaggaatctcaatttttaatgttgggagggactttatgcatctttttgctttcaaaagcaatttctggctgggcgtggtggctgatgcctgtaatcccagcactttgggaggccgaggtgggtgaataacttgaagtcaggagttcgagaccagcccagccaacacggtgaaaccccgtctctactaaaaatacaaaaaattagctgggtgtggtggcaggcgcctatgatcccagctacttgggaggctgaggcaggagaatcgcttgaacccgagaggcggaggttgcagtgagcagagatctcgccactgcactccagcctgggcaaccgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaattttttctttctttctttctttctttctttctttctttctttctttctttcttctttcttttttttttttttttttttgatacggagtcttgctctgttgcctaggctggagtgcagtggtgcgatctcagctcactgcaagcaccgcctcccgggttcacgccattctcctgcctcagcctcctgagtagctgggactacaggcacccgccaccacgtccggctaattttttgtatatgtagtagagacggggtttcaccgtgttagccaggatggtctcgatctcctgacctcgtgatctacccgcgttggcttcccaaagtgctgggattacaggtgtcagccaccacgcccggtcaatttttgtatttttagcagagaggaggtttcactgtgttggccaggctggtctcgaactcctgacttcatgtgatcggcccaccttggcctcacaaagtgctgagattacaggcatgagccatcacgccccgccctaaaacaccaaatcttattaaatctatattctacaactctgtcacatccatcacttcatctctgcccactcctagcactgacttagctgaggacatcatcaattctgatcaaaggaccctaagtctaagtaacaataccactttcatggtaggctttccccggaaccagctggacataatgagaattttcaagagaatgtgaattgctctttacttgattttctttttttttgagatggagtatcgcttttgtcgcccaggctggagtgcaatggtgcgatgtcagctcactgcaacctccacctcccgggttcaagcgattctcctgtcagcttagcctcctgggtaggtgggattacaggcgcccgccaccaagcccggctaatttttttttttttttttttgtatttttagtagagatggggtttcaccatgttggtcaggctggtctggaactcctgacctcaggtgatccgtccgcctcggcctcccaaagtgccgggatttcaggcacgagccaccgttcccggcgattttcttttctttaagactaatctgaaagtgcggaactctgtgtacctgaaatgattacattttgatattgacatgaaaaaattgggtactactttgccccagtttctcaacccaacaaagacattccaaaagtttcctatggggcctaggaaggttggccttcacaggatagtggcaggagtgttaactttgtcctattaccaaaaggtgtcaaagctgttactaaattgtctgtgtcagtatcggaaaccccgacagcactggagaattcctcatggtccttccagaccatggtcacagtgagaagcagattctgttgccctggccctgtggggaaatccccaagatggctgctgatagttaaggaaacagtgtcctgccatggcctgaccctaggctgggtgagagagagtgggtcagacaggctgcacttcctcagtgagtgtgcatacacctgttcgcactgcctatcgtttcctcacccagtgtgagagcagggggctcagttgggctgagtggagaattcatgggacctttccatggtcaaggcccagagcttctattgtgtagcatccctggaacagagaacaggaggcagtcacaaggccccagcttcaacctttgacagtacaccagaaaagaccaagtagtgaggcctccactgtctcacaccagccaagaaagaccaggtcttagactatccagtgttcctgcctctctttcacggtgctgtatctggggaatgaatactccattgtcataggaggggcagatgcgggcggaagactcagaagggtcaaggtaggacatagacattcccactaagctagagacccctgaactgccatagccatgacatgcacacgttgtcctcaaatcccagggccatgggcaggtcttggatatctttggaattttaagttggttggcatctgtctagttttaaacctgatttaggttcagttcaaccagggagtatgattctttggggagagggccctgacctagaaatctacatgctcagcggtctgctcagccactaatggctctgacacactggaaaggcactcaccctctgggagtttcagactgtatctttgaaaacaaaattcagtggatggggtgcaaaggtattgtcctcaacagctctaagttactacttctaactcacagagcacatatcacaaaggatcccactatccattgtcggtctgagcagggaatgagactttggcagaccatgaatcctgtattaatttctagggggactataacaaaataccacagacttgggggtttaaactgagattgcaccactgcactccagcctgggtgacagagtaagaccctgagtcaaacaaaaaaaaaaaaagtgtatacatgggagcactctgtgatgagtaactcaaaggagtggttagaatttgggatctacctagcagcaggggaaaaggaggaggagtaaaggacatatggaaaaccaaatgacttttgaaaagataaatgggcccttagaatagatggaagattcgagtcttgtgacaatgtctatttgggtgtggtgaccacttctcatctccgaggttagatttgcttctagtgctgaagaagatttatgacaactgagttaaaaatttgagatttgcgaggaggatctgctattaaacaggtaagggattttagctgtttgtttcagctgaaaataattcttaagtcgaaactggcacatttggaggtagcatgtcctgatccccttaaaaagggaactgcacagacaccgtatctctgattctgcccagggtcctgtgccctctgacaccagaaatcaccacttctctcagccttgttttgcggttgttttatcatgttgcaatttggttatgtcttttctaatagtgtttaaaagcaatcaaaggcaggaacttttccttttataaactattgttgagcttatattggacactgaactaagtgtcagtttacaaaaatgaataaacaaaaatcactgccagtagggaacacacagccaagatgggggagtagtaagatgtaaagagatgtaaaataatgtgatagattcggccagagttactaaagagtcagaaaagggcaagcatgtttcttccctgtcctgaagcagccaagggagaggaagatatctgttgccaatgctggggtgttggtttaggcatgtagatgctgtgatgcgcagtggaaccgttcaatgagcagacaggagaaccagctttatgcggggagggagagaattgctcccctcatcccccgtgagtcacaccctggagattataagtttaaacattttgatttcgggagattttgagttttgggcttaaaatgactgaagaaccaccaggtggatctacgtgtctcgagtccagaagtctgaatacagatttacgatttatgagcacacagaaggtggatccaagggagagattaaacagggcacagaagagtttttaaaaataatatttttcgggaaaaaaaccccaacaaaacacgattctttcagcagaaaccagaagattttctcatagactctcctacagagagccctgataaagtaataaacatgctaacagtaagaaccccaaccaatttcatagggcagtttgcggtaactactcccagtatggagcagacagtcctcttgcaaaacccgatttagcaaactttgctagctccatgtggggcctccaaaggacacagctgggcactaaatcctggctgaaaacaaaggccgatttagaggatccgtagaaacggatgcacagaatatccctcagtcttctctatgtagcaggccctccatatacgcgggttccccaagaccgaaaatattaaacaaatgaatttcttttttaaaaaaaagtacaacaaaagatagtaaaaataaaaacagtataacaattacttacatagcatttacactggattaggtgttacgaagtaatttagagactatttaaagtacacgggaggatgtgcatagttatgtgcaaatactacgccactttctatgagagacttgagcaacctggattttggtatcggcgggggccctggaccaatcccctctcagttctaccgagggagaactgttttgtttcttccagcacggctttgaccgacagtgtgttgggattcgctgacgtccatgagaaagcttggcagcatgctgagaccaattttcccagggccagaattctcctgtgtgagctaaaatacagtggctcggtccaacaaaacagagcctggagccaggaattatggcgaacctgctccctcccgtcctcccttggcgcacagatccctggcgccgccgctcttgaggtcgcctctcgcgtgtcgacctcatcgtcggaacggcgcttcctgaagctttatataagcacggctctgaatccgctcgtcgggattaaatcctgcgctggcgcgctcctgccagtctctggcctccatttgctcttcctgaggctccctccagagacctttcccttagcctcagtgcaatgccttccgggcgtcctcagaccagacacaggccaaagccactacagaatccggaagccccggttgggatctgaattctcccggggactgtggcgtagcggttaaaaaaaaaaaagagtgagagggacctgagcagagtggaggaggagggagaggaaaacagaaaagaaatgacgaaatgtcgagagggcggggacaattgagaacgcttcccgccggcgcgctttcggttttcaatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatcaatacagaaagcacaatttaattttgacaaggccaaaagccaattctgtatcagcatggcgtatattacagcaagctattctttacgctaccacctctaaattgccctaatttggattaaaatgtgggttcacatttctaatccttatagttttgcagccattgcattgcccgtaagattttttttttcttcattccaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaaaggcaatgctgatgaatatatctgatccgcaccaagatccactaaagaaggagatcaaaaatttgaagataaagcagaaagggagtgggggagaaaacacgtccattgtctgaattagtggttctcaaagtgtagcctctcatctagcagcactgatcacctcggataaaatcttgggacccatgccagacctactgaatgagaaactgaggggtgagacatagtaatcggtgctttaaaaaagccctcccgatacacattaaaggttgaaagccactgatgcaggtaacagcttttctttttttcttttcttctttctttccctccctccctccctccctccctccctcccttccttccttcctttcttccttcccttccttcccttccttcctctttctttttttgagatggagtctcgatctgtcacacaggctggaatgcagtggcacgatcttggctcaccgcaatccccgcctcccgggttcaagtgattctcctgcctcagcctcccaggtagctgggactacaggtgcccaccaccatgccgggctaatttttgtatttttagtagagatggaggttttgccatgttggccaggctgatctcgaactcctggctttaggtgatccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaagtgcagtggcacagtcacagctcaccacagcctcgaacttctggcctcaagcaatcctcttgcctcagcctcctgagtcgctgggattacaggcatgagcaccgcaatttacagaaattgtcactttcatgatttccaacaaaacaacgagcaagttactcgttgttttacaaatgggaaaagttaaacctgttgagatttgcttcctgaagtcatgcacctgtttacatggacaaggctaggaatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggatcacaaaatacaaaaaatacaaaactacaaaaaattagccggacgtggtggtgggcgcctatagtcccagctattccggaggctgaggcaggagaatcgcatgggcccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaatgtgtagagctcaggatagggtctcagcagaagatagcaatttgggagcgcttagctaagggacagaaatagtgaaagcaggcaatcaatctcacttgagttgcagggagaaaagaagatggccaaggccagcatgggggaaaccaggaatattgatggggaagagaaagacatgagaagactgagatggggacctagagaaggataagggtgaccaggagagtggacccaggggacaagtcctcttctaaggaagaaaaatcagtgtaaacgtggccatgtctcttaccacgtagtttccctctaaacacacacacacacacacacacacacacacacacacacacacacctgtcccccactagcctaaggcagaattaaatgtgaacaaagcacgtttttcacttcataaaagccacagattcagagtggacttactggcaaccaaggtagccacgtagaagctggttattagaggaagaggtgggttttcttcgagacagggtctcactccctgtcacccacactggagtgcagtggcacaatctcagctcacagcagcctccgcctcccggacttaagcgattctcccacctcagcctcccgagtagctgggaccacaggcaaatggcaccacccccggctaattttttcatttttctttctgtctttttttttttttttggtagagacacagggtctcgctatgtttcccaagctggtctggaactttgacttcaagcaatccgcccgacttggcctcccaaagtgctgggattaacagctgtgagccacaatgcctagtcagaggaagagtatttctttaccctatccttaattatcctttaactctcacctgagggtagacaatgatttaagtacagggaatgattaaatgttaaaacttaacattttagaatgttatcttgtattgatgaattcagcttatgctggtctcgcaaacaaatacgaagactgacagattcctgtgagtgcaggccttcacagtgccaggaccacaagatgtaatgaattctattcctgactggatataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtccccagcagagctcacctacgctgctctcctcgcttaacacgcctcaggaaaggcaaaatggcagctttacaaaacgaagttttattccatttccccttctcccctcttaattctcatagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactttcccactaagaggccttggacttcccagctcccagagactgtagagatcacctctgtggcctcctgtcacgatttcctaaggcgaagagcttcatttgcccaacggaggcccacgttcttcctgtctgatctactgtcttcccaaggatctgaactcgggcaccagcgtctgcccacatgtccgacgaaaacaacgtaaaggaactactgagtctggacagaaaatccagacataccatgcagcttctaagaggaccgagtgccttcactggaatagtgaatctccttctgtggacatggacagggaacggctcgataaagcccagattcacaaaattccgcccacaccccgtgcccccgggaattttggcttaggggcaggatatgggggttaccactgtgctagtggaggtggcgcggggactgaacggcagccccagcgcagttctccccacgtttgtccgcagaaccccggcgaggccgaggtggtcatttccctccctagccggatggccgcgccgggtgaggccggtttgggcgcgaagcacgggcgtgtggcgctccacttccgcaaaggccagccgcgctcaggaccgcgagccctgagcgtccccctagtgacccctggcctcgtgcccgacgccccgtctctcctgccccggcccccccgccacgcagggccccggtcacgcgcggggggagccggaccgccaaagcccgcgagccggcgcccaggaaagcgtccgcagcccggccagtgcggataggccaattggccgaagtcggcaaagctcaagacggcaccgcagcagggggacccgaccccgttttgttgggagcctaagcggaagtgccttccccgctctaatgccggaggagcacggagggcaagcggtacagcttcttccaagtgctgatgtgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtgggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgtactaatgtctttgattacaatttttaaagtatttcccatttttttattttgaaaattttaaacctacagaaaagttggaaaaaaaagtacaaagaccagccatagtcccttcacctggattcaccaattattacaattttgctgcatttgccttatctttgtcttctcatgtacacagacagcctctgaaccatttgaaaataaactgcaaatatgttggcacttctccctaaatatggtggcatgtctcttaaaaataggatattctcctaaatagctacaatcacattattacacctaacaaatttaatgctgattcagtaatattaatatgcaatccatattcaaatttctccaattattgaaaaaattctatatagatgttgtattagtttcttgtggctgctgcaacaaattactacaaactcaatggttttaaaacaacagtcattctcttacagttttggaggtctgaagtacaaaatcaattttactcggtagaaatcaaggctgcactccctccagagaccttaagggagggtctatttccatgccttttccagcttctagaggtttatttctggtttatggtcccttccctctgtcttcaaagcaagcagcctattaatcttcaaatccctctctccttctatcgcctccttctacacttgactttcttgcctctcctataaggactgtggtgattacatttggggcctacctggataatctggcataatctctcaatctcagaatcacatctgcaaaatcctcttggctatataaggtaatattcacaggctgtagggattaggatatggacatatttgggagccacatttagcctgccacagccattgactactgttatgggttgagttgtgtccccccgaaagatatgttgaagtctaacccctagttgcttagaattttgccttctttggaaacagggtctttacagaggtaatcaagttaaaatgaggtctttagggtgggccctaatccagtatgactgatacccttataagaagacatggagacagccgggtgcagtggctcacatctgtaatcccagcactttgggaggccaaggcaggtggatcacctgaggtcagttcgaggccagcctgactaacatgatgaaactccatctctaccaaaaatacaaaatcagccgggcgtgctgacgcatgcctgtaatcccagctactcgggaggctgaggcaggaaaattgcttgaacccggggcacagaggttgcagtaagccaagatcatgccactgcactccagcctgggcaacaagagtgaaactccatctcaagaaagaaagtaaaaaaacatggagacatacatgaaaaaactgaggtagagattacagttatgctgccagaaaccaaagaacaagtggggctaccagacactgaaagacaggagtcttcccctagtgggtttggagagagcatggccctaccaacacgttgatttcaaacttctagcctctaaaaccatgaaagaataactttgtgttgttttacgccatacagtttgtggtactttgacagccccaggaaattagtacaactactaaaattttttgatttagtttatttaaaatttttaaataaaatttcacatctgaaaaaaaaccctggacatttttcctgtgatggtaatattagtctttagccttagtcaagtattaacatttggacatctgttccaaatatgtaattggagcaactctgtcctaattgaccctatttgacttgagacctttcatgaaaggtctttccttttatctaggaaattattattcctgaaatatttcaagattcaaactggtataagtaaatatgtcagacaaattggcttaactggaagtccaaaggtgcagcagggatccaaggttggctgaactccatgagtggctcagttccctgattctcccacactgtgtcctcctctgcatattgtctataatcattcttgccttcatacctaaagacagtccatcctcctgctgcctcttgaaagcaaataagctgctttcccaaaagataatagcatactacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaagataaaatccaacatttgtttccattaccaccattgcactccagcatgtcatttatccgttgtttttcacactttagcatatatcaccatcacccagaaagcttaacacaaataatggaacctgggaattttcatttttagtaacttcaagtaatgctgatgctgctggtctggagagactttaagtcttaatcactgttccagcccacaacactgcaacagcctcctaattgctttcctcgcttctattgtggccagcctaggatttacgatccccagagcaatcagtataatattttgaggttaatgaggctgtgtgattccaagtccagtgttcccaaagcagaaaacaaacctaatcaacctcccttgcaaattggtggtccttctcctcttcagggatcccaaactctggcttcagaaatcgtatattttgttgctattgtatggaacaaacccttaaactggacaagcttttccgagtgataactcttggggaaaaaaaccatttaatggtattgggtagattttagggtatctcaactagaaagcgcagaaggttatcggtgttaactcctggttatcaaaatcgaacttccatctacctccttaaggaattttcacatgagtggtggtgtaggcacgtgtttgtgaaccaatgatataaaaacctcaggtttctcgataccatatataaaagttgagctattcccttttaagtacacatctgagagcatacaatgcatttaatctctaccttcattttaccactgaagagcggacccaacctttgttcatatacacaatttgatcttacataaacttatcaaaattaacactgcgtttctcaacaggaaacaatctcctgggcacatattcacgggtacgtaaccaggccaaagacagttcaagagcagccctctaaggcaagccccaacctatctatgccatagtaagataccactatcaatctatgtaagcttacttatagcaatgcctatgtgaaaagaaaatagttatctgtgcttggtgttgtgtgctctcctaaagttaaccagacgtgaagccaaaaacatcaactgggactgacaacacaagaaagattctttaactgaggtggttaaatggccctgaaaagagcctttggagacaaagcagccggcgacccgcggagggagggagggagggagcgagcgagcgccaggtcccggcagggactcacttggagctggcgtacttggtgaccgccttggtgccctcggacacggcgtgcttggccagctcgccgggcagcagcaggcgcacggccgtctggatctccgggacgtgatggtggagcgcttgttgtagtgcgccaggcgggacgcctctcccgcgatgcgctcgaagatgtcgttgaggaaggagttcatgatgcccatggccttgcaccagatgccggtgtcggggtggacccgcttcagcaccttgtacacgtagatggagtagctctccttgcggctgcgcttgcgcttcttgccgtctttcttctgggctttggtgacggctttcttggagcccttcttgggagccggcgcgaactttgcaggctcaggcatggccagacccaagaccgacaccgacccccgagaacgcaagcagagcggtaggctcggggtctaccggaaacgactgtgtacttacagaggctgtgcgcatgacgctgcgttatggttcgcgagttttccgcggcgcgcaatgcgagggagacgagattatgtaaatgagtggattctggctgagctatcctattggctatcgggacaaaatttgcttgagccaatcaaagtgctccgtggacaatcgccgttctgtctataaaaaggtgaagcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcagtagtgaatagcgaacctggagctgacgggacgggacgggacgggacgggacggggcggggcggggcggggtgtgtgtgtgtgcgcgccgtcttccatctggagcacgtaactgccttggctcttcgatgagtgggtccccagtcctaggacttcccagggcaggtgcaggcaccaaacgtcctgggcgccgccacggtccgctccacacagtcacaaacaccagcgccgcgggcagtacccaacgcgctgaagtgttgcgcgcggagcgcgcgcttccctagtggtttccgcaggctatggccggacacttagacctagtctggcaccagcgggacgtgctcctcgtccccacccccgatggggagggccctgagcgggtagtgctcgctagtgtggcggagctgggtcttggcttcactgagctgacttaagtcttagtttctgttttgttttccaaagcgccctggcggcggagagtaagggcctcggaggcggaatcttgcgtcctgggggcgggcacctctcccacccaaaaggcacccgacaggcgaaaaacgatccgccaagtagcaactgggggcggggggcaaatggaagaatgaggttccacgcgggagctgtagggcgcagcaagaaagggggggtattgcgggcagtgtgttctaaggaagcgaagggcggaaagggaacaatctgacaaagctgcaatggaaaatgactttcaccctgaaggaaaggggaaaaacaagcttgcgaaacttcgccaactggtaagtagaaagtgaggcggggtgggcgggattagggaggaatctgcccaagccaaccggtgactttaggacgggtgacgtcacagccaatggacagccagcgcgggattttcaattattgttccgcccaatcgggaaaagactgtgcttataaagacggctgcggcggggctaggagctcgtttttctccccgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccacccacatcagcacttggaagaagctgtaccgcttgccctccgtgctcctccggcattagagcggggaaggcacttccgcttaggctcccaacaaaacggggtcgggtccccctgctgcggtgccgtcttgagctttgccgacttcggccaattggcctatccgcactggccgggctgcggacgctttcctgggcgccggctcgcgggctttggcggtccggctccccccgcgcgtgaccggggccctgcgtggcgggggggccggggcaggagagacggggcgtcgggcacgaggccaggggtcactagggggacgctcagggctcgcggtcctgagcgcggctggcctttgcggaagtggagcgccacacgcccgtgcttcgcgcccaaaccggcctcacccggcgcggccatccggctagggagggaaatgaccacctcggcctcgccggggttctgcggacaaacgtggggagaactgcgctggggctgccgttcagtccccgcgccacctccactagcacagtggtaacccccatatcctgcccctaagccaaaattcccgggggcacggggtgtgggcggaattttgtgaatctgggctttatcgagccgttccctgtccatgtccacagaaggagattcactattccagtgaaggcactcggtcctcttagaagctgcatggtatgtctggattttctgtccagactcagtagttcctttacgttgttttcgtcggacatgtgggcagacgctggtgcccgagttcagatccttgggaagacagtagatcagacaggaagaacgtgggcctccgttgggcaaatgaagctcttcgccttaggaaatcgtgacaggaggccacagaggtgatctctacagtctctgggagctgggaagtccaaggcctcttagtgggaaagtgaggcagggtcttgcagagcccactctacacacggccagatacaaatggctgtagaggtcttagataacaccttctcggtcatttatttgcacctcagaagaagccagggcttcggttttctgtttgtttcatcacagttgacaggttaaaagcattcactgcagcgatctatgagaattaagaggggagaaggggaaatggaataaaacttcgttttgtaaagctgccattttgcctttcctgaggcgtgttaagcgaggagagcagcgtaggtgagctctgctggggactgccacatgtttctgctccagggtcacagcaatttctagagcatgcctctgggtctctgccgagaccctcgtaacctgcttaggcccacaatgtatgggcggtattctgacttcaaaaagtagtgactttcagaggtgggtgggtcactatctctgcacccagcttctcaggcccagtagtaactgagcagagactggaacctggggatgttggtgtcagacatctaggtcctctgactgcccccacaaggtcacactccttttactcaccagtctgggtacctctaaactccaggaggtctccctggctgaatctcaaaaggaaaatttcgtggcattttttatatccagtcaggaatagaattcattacatcttgtggtcctggcactgtgaaggcctgcactcacaggaatctgtcagtcttcgtatttgtttgcgagaccagcataagctgaattcatcaatacaagataacattctaaaatgttaagttttaacatttaatcattccctgtacttaaatcattgtctaccctcaggtgagagttaaaggataattaaggatagggtaaagaaatactcttcctctgactaggcattgtggctcacagctgttaatcccagcactttgggaggccaagtcgggcggattgcttgaagtcaaagttccagaccagcttgggaaacatagcgagaccctgtgtctctaccaaaaaaaaaaaaaaagacagaaagaaaaatgaaaaaattagccgggggtggtgccatttgcctgtggtcccagctactcgggaggctgaggtgggagaatcgcttaagtccgggaggcggaggctgctgtgagctgagattgtgccactgcactccagtgtgggtgacagggagtgagaccctgtctcgaagaaaacccacctcttcctctaataaccagcttctacgtggctaccttggttgccagtaagtccactctgaatctgtggcttttatgaagtgaaaaacgtgctttgttcacatttaattctgccttaggctagtgggggacaggtgtgtgtgtgtgtgtgtgtgtgtgtgtgtgtgtgtgtgtgtgtttagagggaaactacgtggtaagagacatggccacgtttacactgatttttcttccttagaagaggacttgtcccctgggtccactctcctggtcacccttatccttctctaggtccccatctcagtcttctcatgtctttctcttccccatcaatattcctggtttcccccatgctggccttggccatcttcttttctccctgcaactcaagtgagattgattgcctgctttcactatttctgtcccttagctaagcgctcccaaattgctatcttctgctgagaccctatcctgagctctacacattttgtgtgtgtgtgtgtgtgtgtgtgtgtgtgtgtgtgagagagagagagagagagagagggagatagagagagaaagagaaacagggtctcactcgtccaggctggagtgcagtagcacaatcaaagctcactgcaaccttggactcctgggttcaggggtcctcccacctcagccatctgagtagctgggactacgggcacacaccaccaggcccagctaattttttttattttttgtagagtcagggtctcacttcatcgcccaggctggtcttgaagtcctgggctcaagccctcctcccaccttggcctcccaaagtgctgggattatagacgtgagccactgtgcctggctacaccaatgtttctaactgcctggtagacaggtccttctggatggatactaggcacttcaaacccagcttatttccaaaaccacatgcctcatcttgctttccaagcccatttgtttctttccacattccccatcttcctggaagacaccttcattagccccatctgttctggttgggtgtcccttcctcttgtcctctgtccaaatctcatgagttccaaatattactaaatctgtcttctgactttcaattgtatcaccttttctccgtccacccatgaccatgccttaactgaagtcctcgccagctctggtctagtagattacatagtcaggctggtctttctgccctgccattgagcttccactccgtatgacagctatctttttttttttttttttttttatgagacggagtctcgctctgtcgcccaggctggagtgcagtggcacgagctcggctcactgcaaccttggcctaccgggcccatgcgattctcctgcctcagcctccggaatagctgggactataggcgcccaccaccacgtccggctaattttttgtagttttgtattttttgtattttgtgatccgcccgcctcggcctcccaaagcgttgggattacaggcgtgagccaccgcgcccggccaagagctatcttttaaaaactgagggttttttgttggttggttggttggttggtgttgctgttttgagcctgtcactttcatgcttaaaaattttccacgaccttcccattcccttcagaatgaagttcacattcttttgcatggcagttcagagcaccggaggttaattactaggaaggactctggagttagacaaacccaagtttgattcctagccttgtccatgtaaacaggtgcatgacttcaggaagcaaatctcaacaggtttaacttttcccatttgtaaaacaacgagtaacttgctcgttgttttgttggaaatcatgaaagtgacaatttctgtaaattgcggtgctcatgcctgtaatcccagcgactcaggaggctgaggcaagaggattgcttgaggccagaagttcgaggctgtggtgagctgtgactgtgccactgcacttcagcctcggcaacagcagtgagaccccatgtctaaaaaaacaaaggacctagcacagtagtagcacagtatctggtccagaacaagcacccaattaatttgtgctactctattaatagttactaatttaaaaaaaaactgaaaatattatacatctagttctttatgtttcccacagccttcccaggtttcagatgttcttgcagctgaacaagaatgtttagccccacacgacatctgcaatctccaagtacacaatatcttcacacattccatttctgtccagaatgtcctccccttctctgtaaccctgagaacccccattcttcaagattcagccctgtgagccttcccttgctcttctggttttttgttttttctttttctttcttttttttcttttcttttttctttttttttttttttttgagatggagtcttgctctgtcacccaggctggagtgcagtggcgcgatctcggctcactccaaccaccgtctcccgggttcatgcgattctcctgcctcagcctccggagtagctgggactacaggtgtgtgtcaccacgcccagctaagttttatatttttagtagagacggggtttcaccatgttggccaggatggtctcgatctcttgacctcatgatctgtctgctttggcctccgaaagtgctgggattataggcatgaaccacagtgcccggctcccttgctcttctttgccctcatctctttgggccctcctccttgcctctgccctctcctatcttaataccccttcccttccttaacctcagcattaggctggcaacatttctcagggtaaggatttgtctttgtttatttccatagtagcagcagtacccaagcaacgcctggtcacagtaagtcgagtgaaaccatctctcaaaaaaacaaaacaaaacaaaacaaaaaacgaactacattgagtgggaaaggcaataaatatatcacctttggtttctgtatcacttcatggcctcattcttctttcacacagaacttttcatttgatccttaaaataatcctgtgaaaaaggcaggaattctcagtaattggccgggcaccgtggctcatgccaaagaaaaagaggccaggcgcggtggctcacgcctgtaatcccagcattttgggaggccgaggagggtggatcacctaaagccaggagttcgagatcagcctggccaacatggcaaaacctccatctctactaaaaatacaaaaattagcccggcatggtggtgggcacctgtagtcccagctacctgggaggctgaggcaggagaatcacttgaacccgggaggcggggattgcggtgagccaagatcgtgccactgcattccagcctgtgtgacagatcgagactccatctcaaaaaaagaaagaggaaggaagggaaggaagggaaggaagaaaggaaggaaggaagggagggagggagggagggagggagggagggaaagaaagaagaaaagaaaaaaagaaaagctgttacctgcatcagtggctttcaacctttaatgtgtatcgggagggcttttttaaagcaccgattactatgtctcacccctcagtttctcattcagtaggtctggcatgggtcccaagattttatccgaggtgatcagtgctgctagatgagaggctacactttgagaaccactaattcagacaatggacgtgttttctcccccactccctttctgctttatcttcaaatttttgatctccttctttagtggatcttggtgcggatcagatatattcatcagcattgcctttaaagttaaaaacaatcagtgatattcgaaatagcaatgctggaaatcacaggtcagatttaaaagggaaaaggaaacatcttgagcattaaaacctctatttctcacctggacatcttcacaaatgttattcttgccacttcctccctgccctcgccccctttactatgtatctcagtaggacgccaatcattctgctctttattcagagtccgacacaagcccccacgtccatagccaagttttccccggtttcccagcagccagtgacttctgtagcattaggattcttatagtagttattgtctacatttctcagcagattgaatatgtactgcctcttactactggactgtttattcttaaatgtgtacagtatggatttatgtcgtctatatattatgcatttatttgtcttcttcgttgtgatggtaagctcctggagggcaagtcttgcatccactgctttgctggcaacccgactggtaagcttctggaaggcaaggcttgcatccagtgctttgctggcaacccgattgctaagtaccgtgttttaagcttagttcagtctcaagtgtttgcagccacatctgaagaccaataaagcaactgctggtttatcctttgggagctgacagaatttcttctcccaaatacatacacagtaaaatcataagcctggaatgaagaaaaaaaaaatcttacgggcaatgcaatggctgcaaaactataaggattagaaatgtgaacccacattttaatccaaattagggcaatttagaggtggtagcgtaaagaatagcttgctgtaatatacgccatgctgatacagaattggcttttggccttgtcaaaattaaattgtgctttctgtattgatggtgggcatgtttctgcaggtctctcattctaagctacaacaggccctaagaggtagaagtcacatacctgaattacctgtgaagttgctttcagatcatatcgttggttcactcttacagaaggatcactttaaaatatctctgcatttgtatccttgcaatgccacaactaaaagacagttatctcataggtccttgattaaattaggaggctttttattgaacacaagaaatgatacttttcaggcactgggcagataacttgctagaaaggcattttttaactgtgctaagattgagctgagtgcgtggctggagacaccacacaacacggacccttgctaaggcatctagtccacccgcttgttatgtagagggtgaaatgaagcccaaaacagtcaatcgtgaactctaagccgatcaggtgggaaagccggcatctctagaatgaaaacctaaggctgcttctcccactttgcctgagcaaatatagtgagattacacagcaaggcatgtgtaaattgccagtgcctatttctcagaaccagatttggtgatcgcaaagactgacgtggccctctaggtgtgcctatactgcaccagaagagcaagccgagaaagcagtgctcaaacctagagcattcaacctttcataccgataaaggctttaaaaaaaaaaaaaaaaaaaaaaaaaaagcccaggtaagtgaaaaagccgctttcggtcaacgacttaagtctttacggctgtgagcgctatgggccgcggtagctttccgttaacttcagatccgattgtcgccccactgccaaagttaccttccaacatcgttactgttgcactttacgcagtcaagtgtccaactcctcagatgagcaagtggtcggccctaaaaagggcctttgggatcgaaacgtgcaaagctggagcggcggcctagcctccgaagccgtacagggtgcgcccctggcgcttgagcgcgtacaccacatccatggctgtgacggtcttgcgcttggcgtgctcggtgtaggtgactgcgtcccgaatcacattctccaggaacaccttcagcacaccgcgggtctcctcgtaaatgaggccagagatccgcttaacgccgccacgccgagctagacgccgaatggcaggcttggtgatgccctgaatgttgtctctcaagaccttgcggtggcgcttagcgccccctttgcctaagccttttccgccctttcctctgccggacatgaccgctggagcccgatagacagcttctgtcaaggcgagcaccgtcttcccctgatatacaagagtatcggaccagattgaaaaccgaaagcgcgccggcgggaagcgttctcaattgtccccgccctctcgacatttcgtcatttcttttctgttttcctctccctcctcctccactctgctcaggtccctctcactcttttttttttttaaccgctacgccacagtccccgggagaattcagatcccaaccggggcttccggattctgtagtggctttggcctgtgtctggtctgaggacgcccggaaggcattgcactgaggctaagggaaaggtctctggagggagcctcaggaagagcaaatggaggccagagactggcaggagcgcgccagcgcaggatttaatcccgacgagcggattcagagccgtgcttatataaagcttcaggaagcgccgttccgacgatgaggtcgacacgcgagaggcgacctcaagagcggcggcgccagggatctgtgcgccaagggaggacgggagggagcaggttcgccataattcctggctccaggctctgttttgttggaccgagccactgtattttagctcacacaggagaattctggccctgggaaaattggtctcagcatgctgccaagctttctcatggacgtcagcgaatcccaacacactgtcggtcaaagccgtgctggaagaaacaaaacagttctccctcggtagaactgagaggggattggtccagggcccccgccgataccaaaatccaggttgctcaagtctctcatagaaagtggcgtagtatttgcacataactatgcacatcctcccgtgtactttaaatagtctctaaattacttcgtaacacctaatccagtgtaaatgctatgtaagtaattgttatactgtttttatttttactatcttttgttgtacttttttttaaaaaagaaattcatttgtttaatattttcggtcttggggaacccgcgtatatggagggcctgctacatagagaagactgagggatattctgtgcatccgtttctacggatcctctaaatcggcctttgttttcagccaggatttagtgcccagctgtgtcctttggaggccccacatggagctagcaaagtttgctaaatcgggttttgcaagaggactgtctgctccatactgggagtagttaccgcaaactgccctatgaaattggttggggttcttactgttagcatgtttattactttatcagggctctctgtaggagagtctatgagaaaatcttctggtttctgctgaaagaatcgtgttttgttggggtttttttcccgaaaaatattatttttaaaaactcttctgtgccctgtttaatctctcccttggatccaccttctgtgtgctcataaatcgtaaatctgtattcagacttctggactcgagacacgtagatccacctggtggttcttcagtcattttaagcccaaaactcaaaatctcccgaaatcaaaatgtttaaacttataatctccagggtgtgactcacgggggatgaggggagcaattctctccctccccgcataaagctggttctcctgtctgctcattgaacggttccactgcgcatcacagcatctacatgcctaaaccaacaccccagcattggcaacagatatcttcctctcccttggctgcttcaggacagggaagaaacatgcttgcccttttctgactctttagtaactctggccgaatctatcacattattttacatctctttacatcttactactcccccatcttggctgtgtgttccctactggcagtgatttttgtttattcatttttgtaaactgacacttagttcagtgtccaatataagctcaacaatagtttataaaaggaaaagttcctgcctttgattgcttttaaacactattagaaaagacataaccaaattgcaacatgataaaacaaccgcaaaacaaggctgagagaagtggtgatttctggtgtcagagggcacaggaccctgggcagaatcagagatacggtgtctgtgcagttccctttttaaggggatcaggacatgctacctccaaatgtgccagtttcgacttaagaattattttcagctgaaacaaacagctaaaatcccttacctgtttaatagcagatcctcctcgcaaatctcaaatttttaactcagttgtcataaatcttcttcagcactagaagcaaatctaacctcggagatgagaagtggtcaccacacccaaatagacattgtcacaagactcgaatcttccatctattctaagggcccatttatcttttcaaaagtcatttggttttccatatgtcctttactcctcctccttttcccctgctgctaggtagatcccaaattctaaccactcctttgagttactcatcacagagtgctcccatgtatacactttttttttttttgtttgactcagggtcttactctgtcacccaggctggagtgcagtggtgcaatctcagtttaaacccccaagtctgtggtattttgttatagtccccctagaaattaatacaggattcatggtctgccaaagtctcattccctgctcagaccgacaatggatagtgggatcctttgtgatatgtgctctgtgagttagaagtagtaacttagagctgttgaggacaatacctttgcaccccatccactgaattttgttttcaaagatacagtctgaaactcccagagggtgagtgcctttccagtgtgtcagagccattagtggctgagcagaccgctgagcatgtagatttctaggtcagggccctctccccaaagaatcatactccctggttgaactgaacctaaatcaggtttaaaactagacagatgccaaccaacttaaaattccaaagatatccaagacctgcccatggccctgggatttgaggacaacgtgtgcatgtcatggctatggcagttcaggggtctctagcttagtgggaatgtctatgtcctaccttgacccttctgagtcttccgcccgcatctgcccctcctatgacaatggagtattcattccccagatacagcaccgtgaaagagaggcaggaacactggatagtctaagacctggtctttcttggctggtgtgagacagtggaggcctcactacttggtcttttctggtgtactgtcaaaggttgaagctggggccttgtgactgcctcctgttctctgttccagggatgctacacaatagaagctctgggccttgaccatggaaaggtcccatgaattctccactcagcccaactgagccccctgctctcacactgggtgaggaaacgataggcagtgcgaacaggtgtatgcacactcactgaggaagtgcagcctgtctgacccactctctctcacccagcctagggtcaggccatggcaggacactgtttccttaactatcagcagccatcttggggatttccccacagggccagggcaacagaatctgcttctcactgtgaccatggtctggaaggaccatgaggaattctccagtgctgtcggggtttccgatactgacacagacaatttagtaacagctttgacaccttttggtaataggacaaagttaacactcctgccactatcctgtgaaggccaaccttcctaggccccataggaaacttttggaatgtctttgttgggttgagaaactggggcaaagtagtacccaattttttcatgtcaatatcaaaatgtaatcatttcaggtacacagagttccgcactttcagattagtcttaaagaaaagaaaatcgccgggaacggtggctcgtgcctgaaatcccggcactttgggaggccgaggcggacggatcacctgaggtcaggagttccagaccagcctgaccaacatggtgaaaccccatctctactaaaaatacaaaaaaaaaaaaaaaaaaattagccgggcttggtggcgggcgcctgtaatcccacctacccaggaggctaagctgacaggagaatcgcttgaacccgggaggtggaggttgcagtgagctgacatcgcaccattgcactccagcctgggcgacaaaagcgatactccatctcaaaaaaaaagaaaatcaagtaaagagcaattcacattctcttgaaaattctcattatgtccagctggttccggggaaagcctaccatgaaagtggtattgttacttagacttagggtcctttgatcagaattgatgatgtcctcagctaagtcagtgctaggagtgggcagagatgaagtgatggatgtgacagagttgtagaatatagatttaataagatttggtgttttagggcggggcgtgatggctcatgcctgtaatctcagcactttgtgaggccaaggtgggccgatcacatgaagtcaggagttcgagaccagcctggccaacacagtgaaacctcctctctgctaaaaatacaaaaattgaccgggcgtggtggctgacacctgtaatcccagcactttgggaagccaacgcgggtagatcacgaggtcaggagatcgagaccatcctggctaacacggtgaaaccccgtctctactacatatacaaaaaattagccggacgtggtggcgggtgcctgtagtcccagctactcaggaggctgaggcaggagaatggcgtgaacccgggaggcggtgcttgcagtgagctgagatcgcaccactgcactccagcctaggcaacagagcaagactccgtatcaaaaaaaaaaaaaaaaaaaagaaagaagaaagaaagaaagaaagaaagaaagaaagaaagaaagaaagaaaaaattggtgatttaggcatttggagaatgcatgcaataaaggagcttctggcctgaggagctatggggttgatgttaggtttcagtaacatggagaatgcagagagaagaaattgcttttatttttgtttttgtttttttgagagagtctctctcggttgcccaggctggagtgcagtggcgagatctctgctcactgcaacctccgcctctcgggttcaagcgattctcctgcctcagcctcccaagtagctgggatcataggcgcctgccaccacacccagctaattttttgtatttttagtagagacggggtttcaccgtgttggctgggctggtctcgaactcctgacttcaagttattcacccacctcggcctcccaaagtgctgggattacaggcatcagccaccacgcccagccagaaattgcttttgaaagcaaaaagatgcataaagtccctcccaacattaaaaattgagattcctgttctctacctaggagaacacatccaccagttgttattactctgatcagtaaagggtctcagctggagaaacttgtgagtaagccctcagcaaatcgataaggaaaacgagaggcagggaatttgatgagatcttcccaggggttagggagaaaagaagaggactgagacaggcaccctgggcaagcaggaacattgatgggagttggtagattaggagaataccaagagacagaggatagctggaaagggatgaggaccaccagaagagagtatgtcccaaggaggcaaaggaggtgtcaacagggtcatattgggcactgaagttcagaaataatgattataacttaacattccttaagctcagtgactgctgactatgcttgatattttgtcttacacatcaccacaacaatcctgcaaggaaggcagatgttttatcattctcactttacagactgggaagctttgagtattttgcccaagttccccaaactattaagtgtcagggccagggactttgtccaaagtgctaggtcttccaaagttcatgtgcttgggcagaaaacagccaccgagaagcttgtactggaaactcagagaggaaatgacaggaggcattgtgacacacagggttgagggcctcactgcttctcctgacttctctaccttttcagacagcattcttctcaggttctaacaagcttaccctctcctacctgttttagcagttcctcccagattcatttatccttccagttccccgtgaaattctgagtgccgtcagaatgggcattttgccttgttcatctcttcaagtcagcatcctggagcatagcagatgatcaggaaatgcctgattgccctaattccactggcctctgaattctcactcaaaacggcataatacccaggcccctcctaggtttcaaagaattctcgggaatttgcaggccagaagcaagtatagcctggactctggaaggaacttcctccaggttggcccgagaagagggagaggtagctgccctgagctgtaccccttgcctacaagttgctacagtccaccatcaggatagttgtgtagccttagctgaaggcagagttcccctcagtgctcgaagataaatactttagaaaggagtgcacatttgtggtagactgaataatagccccacagagatatccacatcccaatccttggaatctgtgaatatgttaccttatatggcaaagggactttgcaaatgtgaacaaattaaggaccttgagataaagaacttatcctggattattgagatgagcccttaatataatcacatgaatccttagagagacgagagggtcaatcagggagaagggggtgtgatgacagaagcagacattagagtgatctgtccaggtgctaaaaaatgccagtttctagaagctggaagagtcaaaaagtggattatatacctggagcctccagaacaaaccagtccttcagacatttgttttagccccttaaaacttatgtttgggcttctgacctccagaatggtaagagaataaatctgtgtggtttttttcgttttgtttggtttcatgtttttttttttttttttttgagacggagtttcgctcttgttgcccagtctggagtgcaatggcgtgatgtcggctcactgcatcctctgcctcccaggttcaagcaattctcccgccttagcttcctgagtagctgggattacaggcacgcgtcaccacacccgactaatttttgtgtttttagtagagacgggttttcaccatgttggtcaggctggtctcgaactcctgacctcaggtgatccacccgccttggcctcccaaagtgctgggattacaggcgtgagccaccacacccggcaaatttgtgttgttttaaaccactaagtttatggtaacttattaatgcaacactaggaaatgaatacaccgttcttacaaaagtcactaggctctttatatttgatgggggcgggggggcggggggagatctgagtgtcatcaggagcagagtataaggtatacttggagggaaagaggaaaggaagtgggcagcagaggtaaaaaggagatcaggaatggaaagtcgggggccccacagtgaacctttccttacggctgactaggctccttcatgggcctgaccagcctccttcacctgctcagcccagaatttgtagagagatctgtcgtctttgcaagtggactgagctctcctagacaattgctggcctcccccagccatggacctctgtagagctccctggggtcatccagggcaggagggtgacaggctggcttcaccgtggtcatatagcagaagtggcaagctcttcttgctcttgaggaaagctcacacctagattgttgcaaggatgttgtacaggttgagcatccctaatctgaagatccgaaaccctaggctccaaaatctgaacaattttgagcactaatgtggtgcctcggtggaaaattccacacctgacctcacacaacgggtcatacaatgcacagtatttcccccaaggaaataaaaggccctcccagcccctttccgctgagatatatcttttctgcacatgcccggtttccccaacgtgcacacacccacaaagggtcataaaatggcatgtgtgcaggccagtgtcgtcaacagcacgttccccataatgccccatgtaggagccaagacctacgtgccttactcactgtggggtttttttgcttattctctgctctgtggtataaagatattgttgaaaatatcaaaaaggcctgcagataccccatgagtaacagtaattttaaaagagaaaaagcaaggccaggcgcggcggctcatgcctgtaatcccggcaatttgggaggccgaggcggctggatcacttgaggtcaggagtttgagaccagcctaaccaacatggtgaaaccccgtctctactaaaaatacaaaaattagccggcgtggtggcacatgcctgtagtcccagctactcgggaggctgaggcagaagactcacttgaatccaggaggttgcagtgacccgagattgtgccattgcactccagcctgggcgacagagcaagactctgtctcaaaaaaaaaaaaaaaaagggagagaaaacatttatgtttatctatagtacagaaagtcaagttgttggagaaaatggggcacagtgtaagtgtgtataaggtatttatgaaacatagatggattttgtgtttagtcttgggtcccatccccaatatatctcattatatatatgcaaatattccaaaatctgaaacccgaaacagtcccagtcccaagcatttcagataagggatactcaacctgtgttagtttcctagggctgccatagcaaatgaccacaaacttggtagcttaaaacaacagaactgtattcttccacagttctggagaccagaagtctgaaataaagtaccatgctccctctaaaggctctcagggagaatccttccttgcttctttcagcttctggtggcttctgatgttccttggcttgtggcagcctcattccaatctctccctccatcttcacatggcttcttactcatctctgtgtgtccgaatttccctctcctttctcttataaagataccagtcattgaatttaaggcccatcctatatccagcatgatttcatctcaagatccttaactacttacgtcttcaaagccccagtttccaaatgcgttcacattttgagatgctggatagacacgaactttagggaacatattcaacccactacaggtcctgagcactaagccttgtgggaggacactctggaagcaggtccagacttccccggtcttgcctcttcagaacctgcgcactctccacctccaaaaggcccttctatcagtcacttacacctgagtataaaactaagcatgatagctgtgcaattttgaccaaccctcccatgttcatgagtgtaggtgttggggaacaggctgtgtctccacttggggaactcacagcttcaggggcaggacaggaagatggtggtggtccttggccagatgcttcctataataatgaaaagcctgaatggttggacagctggcagactgtggcctgcatttacttgcctggaaaagctggaaggaaagaagacatgaggctaaaatagaggctcagtgtcttagtttcaatatctgtaaaacagtaacaataaatacacatacctcataggattcgtgcagggataaattgctatacagtccatacaaagtacttagagcagagtctcaacatgacaataaattaatagttattagcaatttcattatttttatgataaacgttacttgatatatatcctagatctttcccttggaaatattaccgtcatgctgggaaataagacaagcacatggaaaataatgggtaaattatctagtctctagatgctaattatgtagagattcttctagactatgtggccaaggcagcagaaataattgggttcctaggagcttcataactcacaaaaacctttcactaacagcctctcgtttgagtccacaacaaccctggaaagaagaaaaggctttttccctatgttaaagataaggaagtttctggtaaagattagacaccggggaacgtgagttactcggctaaaacatggccaaggtggaatttgagcctaggttttgtgttttgcttttctttttttgtattagatttgatgctttaggagaaagtgatacatggaatagatacaaataatatcaatatgtgtacagtacagcccactctcctgacctcaagtctacagtaagaaatacatttacattggccgggcgctggggctcacgcctataatcccagcattttgggaggccgaggcgggcggatcacgaggtcaggagatcgagaccatcctggttaacacggtgaaaacccgtctctactaaaaatacaaaaaaaaaaaaaaaattaaaaaaaagtagccaggcatgggtggcgggcgcctgtagtcccagctactcgggaggctgaggcaggagaatggcgtgaacccgggaggcggagcttgcagtgagccaagatctgccactgcactccagcctgggcgacagagtgagactccgtctcaacaacaagaaaaaagaaatacatttacattgcctcccagtcacattcacaggaaaataaaaattgcaacaagtttcacaaaatgataattactattggtgatattttcccgttttatgattcttacaaaagggcaaaatgaaaggaaaagatgatctctaccaagtaaattaattgcactatggattacaacttatagttgtggttttttgggaggtttttttgtttttgtttttctggatttttttttttttttttttttttttttgagatggagtctcgctctatcgcccaggctggagtgcagtggcgcaatctcagctcactgcaagctctgccttctgggttcaagggattctcctgcctcagcctcctgagtatctgggactacaggcatgcggcaccacccctggccaatttttgtattttttggtagagacagggtttcatcatattggccaagctggtcttgaactcctgacctcaggtaatccacccgcctcagcctcccaaagtgctgggattacaggtgtgagtgaccgcgcccggcctacaacttacagtttttaaaactggctagagaaaactacaaagaagaaagttaaaatcatctcactgatttaaagaaagttaaaatcatctcactgattttaaaagtcttcatgtttcttctgaatctttctgtgtatgcacatacaacctgtctgtctttgtgaggaggtgacccccatatccagagccagagtggaaggtatcctgtgacagatggtgacttgaaatgtaggttgaggcctggcgcggtcgctcacgcctgtaatcccagcacttcgggaggccgaggggggcggatcccctgaggtcaggagtttgagaccagtctggccaacatggtgaaaccccgtctctactaaaaatacaaaaagtagtcgggcatggtggcaggcacctgtaatcccagctactcaggaggctgaggcaggagaatcacttgaacccgggaggcggagtttgcagtgagccaagatcgtgccattgcactccagcctcggggacaagagcaagacttcgtctcaaaaaaataattaattaataaataaataaataaataaataaataaataaataaaaatacatgcaggttgagctttgtgggagccaagagggaaaggccaaggccagctgagcaaataaaggaacccttccaggaggaggtgatatctgagcttggttctaaagaatatttaggattcgggacatgtttagattgggggtttggagaagatgatgtaatccaggcaagaggggacagcaaaaacaaagacagaagaattgttcctggaccacatgcagcatgggcaaaggtcagtcatgagaagtaagctttagcaatgggggccagtttaggggaccccaaatgccaaagtagggagggagtgctctataaacaatgttggagcaaaggatatgaacaggcaatacacaggagaagaaatccgaaaactatcaagctcaggtagagatgcttgaactcatgaatacccagaacaatgaaaacgaaagcaatgctgagataccactttacaccaggcagtctggcaaaacttagaaagttggatgacccgaggactgggcctggatgtgggctcagagtccagctaccttggtattggaagtccgggacaagcattctggaggggagcctgacactccttagttcaattagatgtaaataaaactctgaacagaactgctggtttctggcttctcagcacttctgttcctgagtttttatccaaaagaaattcttatataggtccaaaagggaatatatacaacaatgttcattgcagcatttctggtggtgatggagaattggcacaagcctagttgtccattgctgggaaagtggggagataaaatgcggtgttggagcaacatgaagtttaatgcagattgacctcatctctacaaaaaaataaaatattagccaggcacagtggcatgcgcctgtggtcccaattgcttgggaggctgaagtgggaggatcacttgagcctgggagattgaggctgcagtgagctatgatcatgccactgcactccagcctaggggacagaatgagacccagtctctaaaaaaaaagaacatggatggcaaagagatgcaggttgagttctataagggttgaaaataaaaggtaatttttttgggaaatcaatatgaagtttatttaggtttcttgtttttcctgttttccctgtgagccagatgactgccaattatcccaaaatttatattatcaaaaatggatacctgcttcctagcatttggaaaaataaaataatatgcccctgacatgaattaatgaattacccctctaattacaaagtacagaattctctcttttttttttttttttttttttattttgagacagagtctcgctctgtctcccaggctggagtgcagtgggatgatctcggctcactgcaacctccgcctccctggttcaagggattctcctgcctcagcctcctgggtagctgggattacaggcacgtgccaccacgcccggctaatttttgtagttttagtagagacggggtttcaccatgttagtcaagctggtctcgaactcctgacctcgtgatctgcgcgcctcggccttccaaagtgctgggattacaagcgtgagccacgatgcccggcctggtttttttttttttttttttttttttgtcgttgttgttgttttgtatgtttgtttgttttcaacttttattttaggttcaggggtacatggaagagttcaatttttaaaatatagattaggccaggcgcggtgtctcatgcctgtaatcccagcacttgggaagaccgaggccggcagattacgaggtcaggagatcaagaccagcctggccaacatggtgaaacctcgtctctactaaaaatacaaaaattagccaggcgtagtggcgcgcgcctatagtcccagctactcaggaggctgaggcaggagaatgaggcaggagaatcgcttgaacccgggagacagaggttgcagtgagctgagatcgcaccactgcactccaccctggggacagagcgagagtccgtctcaaaaaaataaaaaataaataaaataaaatatagattaaggggggggaataataaataaagtaagatataaaacacattaccactaacatgcacttcgagaagcagaaattcgctaggactgagaaaatcaaaacctgttctgccattcattaggctgcactaacagagataaagctagactagaaatgacagaaaacattcttctcccaagggcatgctacagctataaaggctcataactcccctctttgagtgaccactcctttcttattcactgaggaacttgtactcaaaattacagactatcagaactttggctgcttgaaatcctatcaatcagtaacaatgcagtatccccctcctgtctggaggacctaagccaccttgacacaaaaaaccagcagtaattttcaacccaggtgcaaaaacttcaagtaaggggtttctgaacacagcattccacctctatctcaactttgtagtttctgaggaaacaagaccctggatccactgcaaagtcccatcctatgcctaccctttcacacagccctgctttgctttgagcctatgaaaactacactccactcgtcccccaaaatcaatgataactctaattttcctcttgtttggtgagcaccctcctcccaccaccctgccaccagtttctctgttgtgtgttctccctcattgtaacaagtcaacagacttggcttaggtagactaagtagtggtcttgggctaattgggataggttgagtttttacttagaattaacataactcatttcagcattcctacgttgtcggaggtggttttgttttgttttgtttttaagacagggtctctgttgcccaggctggagtgcagtggtgtgatcataactcactgcagactgcagcctcaatctcccaggctcaagcgatcctcccacctcagcctcccaagtagctcagactacaggcgcacaccaccacgcccaggctagtttttatattttttgtagagacagggttttgccatgttgtcaggctggtctccaactcccaacaaacttgcccgcctcgggctcccagatgctggaattacaagcatgggccactacaccccggctcttggttgtttctaatcttttaaattactatcaatgttgcatcaacatcttacttatttgatattagtagtgtagtatagtgactaaaggaagactctggagttgaaatctggtttggcaccgactgtgtgactatgagaaagtttcttaaccgctctgtgattcctccatctcccaatctgtaaatggacatacttacactacctacttgacagggttttgtgaggataaaatgagttaatacatgtaaagtgtttaaaacattcttggcaccaagaaaaagtatgtaagtgttagaaaaaaatatgcatatataggcggggcgtggtggctcacgcctgtaatcctagcactttgtgaggcctaggcgggtggattgcctgagctcaggagttcgagaccagcctgggcaacacagtgaaaccttgtctctactaaaatccaaaaaattagccgggcatggcagtgtgcacctgtaatcccagatattcaggaggctgagacaggagaatcgcttgagcccaggaggcttcggttgcagtgagccaaggtagcgccattgcactgcagcctaggcgacagagcaaggttcaaaaaaaaaaaaaaagaaaagaaagaaaaaatatacatatatgtggtgttataatgtatattggtttctgtccacagttcctggctcataacttccatagcccttgtatggtctttttacagagtacagtacactccaatgttgggtatgttaggccccagaggcaggtctcaggaaacagaatctctctttctcctgccctcctttcacctgccccaaggcagaactctaatatttgcccacttttttaattgagggtcttaagaccctccccggagaggttcccgccctataccctgggggaaggaatgctgacatcatgaagcttccataaaaacccaagaggaggccaggcgcggtggctcatgcctgtaatcccagcactttgggaggtgggcggatcacgagatcaggatttcgagaccagcctggccaacatggtgaaatcccacctcaactaaaaatacaaaaattagctggccattgtgactggtgcctgtaatcccaactactcaggaggctgaggcaggagaattgtttgaacccgggaggtggaggttgcagtgagccgagatcataccatttcactccagcctgggcaacaagagcaaaactccgtctcaaaaaaaaattaataaataaataaaaataaaaa

SEQ ID NO: 271 - DNA, 779729 bp, Homo sapiens
  misc_feature (417714)..(467713): n is a, c, g, or t
ctggttctcaatcttttgctcattcttttctctcattttgatgatgtgtctcttttctccctaactttctgtttctaggcattttcactccatacccaagctgactagacttcctcaggcaccattgccctcagctccatccagtttcctgcctttcaggcccactggccctcccctccttggctgctgtgagacaccggtggtctccttggctgaggctcagcaggagctgcagatgctgcagaagcagttgggagaaagtgagcacttctgcatttgtgtgcttgtgaatggcagccccacactgtgttgctctgcatggatcgggctggatggcagagttcaaagaaacaatatggggacatgttacaaatggaagactgagggaaagctctgcttgcttattttttggaaatgtatttcctgttatttctctgatgtgtgtctcatcagttaacaggtagatatgttcaagaggctctagacctggtgctttcacactgtagatagtgtaggataccaccaagtatgctgaatccctgacagactggtggactgctcattggtaggggatgggaggagatgttatgctttgcctatgcaggatgaagtggccaagaaaaagagggccacattcagtgggctcctttgtgtggctattacacttttctgctgtgaaatgctgttaatcaagttcagttcctgacatcattaggttggagcaaaaagggtaatggtaccaaagtgtcagctatggcatctgactgtgaatcctatcttctgactcccaaagataattgaccttatatagttatgtagactgtggacagtcaccttttagaaaatgctagatatatttgtaggctggatgctcatcataaatttagtatgctggtggtcattgatagcttaaaaaaaaagacaaaccttcacatgaatttgctctctcgtagcaccttaagcacaacagttagaaagcagtttgaatgaacttaaactcatttgtcaggcactttctgtgcctgcaaagaagcttaggtgagccagagactgatagggtcaccatgccagcagtttctagtgaagcaagacaacagccaagaatttgcatccccctccctgtagccctaaatgtcatgtggaccaacctatttctttccttcttcctttctttttttttttttttttttttttttttgagacagggtctcactttgtcacccagactgaagtgcagcggcatgatctcggctcattgcagccttgacctcctgggctcaagtgactctcccacttcagccccccaagtagctgggattacaggtgtgtgtcaccatgcctggctaatttttgtattttttgtagagatggggttttgccatgttgccaagactggtctagagctcctgagctcaagtgatcggcccacctcagtttccaaaagtgctgggattacagacatgagccactgcacccagcctagcctatttattttgtcaacccagcaaatggatactttgtctagtgcagggaactctaaagctcagggaagtgaagttacttgttcaaggtcactaggtgggagagatgggcttgaatctggtcttccgctccaggtttcacgtttctgttataccttttctgcttaggatggctttgtcaccatcctgcttagagtatggggctgagatcagctgatcaaactctggggaatccttgcaacaatttttttcctctctttagagaccagtaggaggtgctggtgtttctgacccaaaacttgttactttagcagttgtggcaccagcaatgggtgggcaaaaatgtcccccaagacaaatggcaagagtattttctagtttccatttcttcctcttgcctccttttcctttatctatccacatttgtccatttgtctttgcccaaagggaaggatggaaggagagcactgtccatgaaaaagggtctattgttttgggttaaattggaattacgtcaagtctgaggtcattgactggagatcaaatggtcccagcctagatgaggaagattgtagccctttctttctccacctgaagtcaaggtcctctccaagggccattgcttatccaagctcactgtttgcgttgagccaattttccgtgtggacagtggtgcatggcggcctctcaggtccctgggttaaaatcttgtgcaagagtctgtatggtatctttgcatggtttagagcatgtactgtgtattgtgtggccaatggactggaacatgagaatactgatcattgttactgatagacttaaaacctcacatggccttgattaaaaagtaagctgactatctacaaccactgatttctccctttgccttgtgtttggatggggttgaaggcagtttgaaagaggcaggaaatcacgtatttgttgcatcccttcaaaaatgtaggtgcttaaatttttaatcttcttccttaactaagtgatcctgatgaatatctagtattttgcaaattggaggagagactcatcacaagacttctcaaacttctgcctgttagaatcacctcagtatatgtttccatactttctcagatgattccaatatgtaccaacatttgagaaccagctacaaatggggctaaaagctggcaactggcaattacactaacccctccgaggagtttggcttggttggaagaaacaatgacctcactcctgttgcttaggaggagctacctgtctattctgctgcccatgttcataatccctgaaagaaagcaggcttctgaattttctcctaaattgcacttctgcccacctctttccctatctcctctatgctgggcttctttttacagagaagtggagatgaaggggctcaagggaaaggcctatgatttcaaagggtctatgaaagtatcagcctatgaaatgaaagtcctacctgcctctgtggaatagtattcaatgattctttagacaggagtgatgacattttgcagctctttgagtcatgttggatgggatccaaataaatacttgctttacataggcccttccccagcctcagcaaagagttcttcattctggaggaattagggccatcatatccagcttgacttcatgtcccctttctcttctgaaaaactccaaggtggaactgacatattgaccggttagtttcaggggaaggcaagtacatgtagacaaacaaacattcatgttcacaggtaagctcaatcctgtatgccgctgcactcacaacttgtaactgtgggagtgaatcctacttttagaactttccttggagtctgtcatgaaggattgtagtaggagccaggagcagggccactggacttttccattgtgtatactgatgactttaagatactttattctctacctcttgtgtctcctgctaggaaatacaaagggtgagaattacaacctctaggttacaagccttagtctaattggtataccacagtgaactgtgatctctgacattccacaggtctccttttagtctctattcttagtaatcacacacttccttgaaaatccttcccttctgacaccgcatttgcttcttactcatgtttctttctgcccaggtgccagcactattcctcctgcttccacagctacattgctgagcaaagacttggaagctggctcttcccactacctcaactctgcccagcctgactctcctccaagaggcaccatagaactgggaagaatcctggagcctgggtaccagggcagcagtggccagtgggacatgatgagtcctcagaaagggagtgtatccggggacctatcctcaggctcctctgtgtaccagcttaactccaaacccagaggtaaagcacaaagtggagatggcagcctttgaaaagaagtctcattcagagtctattcttttcctacccaggcaggactgtttcattcctcctccatccctggctcacagagtggggggtataaaatgaaagacctgtatcagggctcaatcctttccaagtacgttcttcattctcctgcccagggcctcagagctctgtagggatatgggaaagtcggggacccacctcttgtgctctcatactcatgtccttccatctctctgcagcctggactctttgcagcccagcctctttgcagcccactctcttagacccctctagaatgccaggcatagatgggactttcttccatcagtcaggagttgtcacaggaaagggtgcaagggtgcagctccccaaccctgcacatatatcctgtgaacaaaattcagtcacagcaagtggagaggtatagctaagctcataaatgctgggatgctactcagttccaacagtaagacaatcgtaattttcaggaaaagactgagcccaaagcaaaatggttcagttaatatccgacgtgagcatccctctgacttttctgcatctttttcctttgtttggctgggggaggggggtggtgtcatcccctctctaatctgccctcagatctctagatccttccaggctattctttcatcttccatattaaaagtgatttcagggaagcattcagtgtcagtcattaactgcatagggtgagtgtaagatcacatacttttactttaggccttctttctaagggtgggaggaagggctttgtcccttgctaaagaatgctcactcatgtgtcagtaagaagaaaggtagagtgaggtctcacctatcatcctcatagtcacacccaggaggtggccatacctttccagatgctaggcaggccttgtccagagccctcagttatttttctaaaacatgtggaactctcacaagacccctgtgtgggaggaggcccatggagatgttttagcaagtgactgttatgtgtttgaaagcacattgactgtttaaacaaactaccattcctttgggtgtccgtgtgacagcacacagttggcagaagactagtgatatttacaggtcttgctgcaaggcccctggctaggccccacacccaccagtaaccaggattctccatctcccacctctctccatgtcctgttggtttggctacagggactgccctggtggaagagcatcttggtgaaatccagaacttgcgccagcacctagaggaatccatctgcatcagtgaccacctacgggagcaactggaacaccagctgggctctactgcccatggaagtggtaggagaggccaagaccttcctgtttctggctctatttagggacctttaggcagagcttcacagatattctttacttcacttgctccttataaatagtccaacaagggaggtgggcaagtactgttatccctactttctgaatatatctgagtttagagagtaactctctttaaggcagaactagatctggtccccagaatcacctgacatctcaccccatacttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatcttggtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacattggtaataatgtaatgatgggtacatgacattatgcgttttgcaaaactcctagacctgtaccacacaaagagtgaaccctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatctcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaacttcgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaaaatttattatttgatgtttgttgctgtgtttgaggaattcctcagcctctcagttttgacgaaaacaagaaaccacctcctgctttagaagctaaaatgccaaatgcttgctttctcagcctcctttgcagctagggtacaagcatatgacttaggttttgcccatctgtttgccagtgctgaatttccacttcggaattaataaaaaaagaagcagattcagttatgctttctcttgtttctggtggaggccatgtagcagctgctacaatatctgttgcaaagcgaacaagtgggagtggtgctggtggctttgcagttagcctaggattgagcaattgctgcaattgttgctgcctgcatcttcggtgttatttcttactggtggtgacagtggtttcctccctggatgagttctacagcatggtttggggtacatttcctggctgcctagctttgatctggctttctagccttctcaacagttctacaagttccccactatttctgtgataaacctatttattgttaatgtcagccataattggcttctgtggtttatattttttaaaattccaagatataccaacgtaacagatagctcaacaaacatatgtctttttaaattaagatatattctgtgtcacatgaagtacaatggacaaaatgcaacaaattgaattgagcaaaagaccaaatatatattaagcctggctggtcttaaaaatgtaactggatacagccaggcatggtggctcatgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagcgagactttgtttcaaaataaaaaaataaaaataaaaaaataaaaatgtaactggatagacctaaggttcttgaataagcagaaaataatttaggtaaaaaccaaataataaactaacattctgaaaggtttaggatttggaggcacaaatgtcttagctaaagtgttcattctaacctcacaggaaaattgaaatatgaaaatatacagaaaaatcttaggcagtatttgtcaattttaagaaacaactatttacaggtttttcaataggcattacattaaaaacgaaatatgtagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagttttttcatttggaacacacacccattccccagtatactaggggtattaataatttaaagagtttaattactttttactactagaaaactaattttatgtttggcacaaatttctgaaatgatattctactgcaaagaataatacctatatatggccagaattactttttttctataacattaagataatacttgtcagcctgagcaacaaagtgagacctcatctttacaaaaaataaataaattagatgggtgttttggtgatgaggttctgtagtcccagatactcaagaggctgaggtgggaggatcccttgagcctaggaggtcgcggttgcagtgaactatgattgcaccactgcactccagcctgggtaacagagcaagatcctgtctcaaaaaaaaaaaagataatattggtataattcagggtttttgcctcagtccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattacctcaaaaatatgacctgctgaatttctgctgtcatgaattgactaacatattttgggcctaatacctttacatttagaatctttttgttttgtattggaaagtattgtaactcctccatttattggtcaaaagcactgcttatttatttccatgcttaatcagagagactttctaatagttatttaatattatttacgttcattcacttgttgactataatgacgttagttgctatgatatttttaggtcattaatataataaaaatatgtcaacttttctcttccaatgtgtctttgggttattaatttttaactcagatatcaagcttgtaaaatgtttaatggcttataataatgtctaacacatagtatccactgagttctgataactccagtttatcaaattctctttttttataccattctccaaatgcaatgctatttggttttatttttattttttaaaaatgtgctgcctgttttgagtctctaaaagtgtgaaatgctcagtattttccaaatgtatttgaacatggagtgttatatttactaaaaagttaacaagcaagtattcccctaaacgttctagcaaatactactagtacagacaaattatgatgtaacattatagtacattttaatttattaggttaattttggttgcaaacaatcaaaattcaaaatggcttgtataataaagagattttgaacaatagtataggctcaagatagtttaatgcagaagtttaataataacacaaaataaatgcttcttgtcctccctgtttcttcactctaccttaagtgatatagattgaatgtttgtatccccccaaaatttgtatgtttaaatctaatccctagtgtgatgatatttggcagtgggtcttcagggggtgattaggtcatgaggacagagtcctcatgaatgagattagtgcccttataaaagagaccttagagaacttcctagccccttccaccatgtgagggcacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaagacattaggtctcagttttattctatggcttaaaatatcatgtcatgagtagacaacttccaatcctagtacctcgtgcttcctctgctgcatttggaaagaaggcatttccctcttcaatcatggaatgaaaaagttgtacttcattctgatttgattagcagaaggcacacgttccttcatgcaccaattacagtgaccaagaattgggcatgggactcatgtcacttaaacattgtgaagctgagaaattcattatttggctaggagtgtgtgagagcagggaacactgaatgcttgagacaccaccacgatgtccactacatgtatttccatttcagtaaacatttccattaagataatgctagaacaaaatcagaggagtagatcttagtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacgcctctacatatattttggaggcctttacacaaaagtgttttccctaaagggagaagagaaaagttgaatgcagaagtagaaaaaaaaattcatttgcacttgtagtatttatatctaaatattttatgttacagatgtattaatatttttataattttaaacactactttaaaacagggagatggtttaccttcaaaaaatttggctctcaactcaaaattatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcgaaagaaaaatagctggttttaaggaatgaatggccatgtcaactattggaagcatctttgaactagagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaaatcaatttttttaagaagaagcatttgatctgccaaagagaagagttagtagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataatttcttgtccattcgtgtatgtgttatggtttctttcttagaaagaagtatgctatactagtatacatactatttattcatgaaccttgcacttatcatgtaatcatatgtcttagtggtcttttcataatagatgtctctctttcccatgctgtcagtggtgactgcatgaggcattgtacagacgtaccaataattacttactctgtgtcatattgatggttattcagattgttttcactttgcccttgcagacaacactgcaatgaacatccttatgcatatattattccaaatacatcatcgtgatggctgtgtgagagaaatacacattgttgattttcttttttattttttataatttcagcttttgattttagatacagtgggtacatgtgcaggtttgttacatgggtatgttgtatgttgtataatgctgaggtttgctgcatgattgatctgatcactcaggtactaggcatagtagttttttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataacggcatcgagttgcatccatgttgctgtaaaggacatgattttattcttttttatggctgcaaagtattccatgacatatatgtaccatattttctttatccaatccacagctgatgggcacctaggttgattccatgtcttagcgattgtgaattacactgctgattttaatagaaaccactaatttttatgccaacaaaatcatcaatgtgcacatgctccaaggctgtgtgagcatagccctttttcttgagatgtcaacaacactgggttttatcaaaatataatttttgccaatttattagttaacaaatgctaactcagtgctatttggatttgaactaccactggtgctgagcaactttttacatattcactggcaatttatttatctttctctgttgtttatctttttctgtgtaataattttccctatcttctactcttttaaacattaagttttcactgttttcttaataatttttaagtttaaaaagtgaccttttggctggacgcagtggctcacgcctgtaatcccaacactttgggaggccaaggcgggtggatcacaaggtcaggagatcaagaccatcctgcccaacatggtgaaaccctgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactctgtctcaaaaaaaaaagtgaccattttatctgctgcatataattctaatgatatttctcaattcgtttatcttttaacaatgataatatataatgtcttgctatttagaaagatttttaaaagtattttatataaacaaatttttattctttgccattaatacttgcaggtttggaattttcaggacctcctcaaaggccacctacaggaaatgctcttcaaagacatttcactttttccccacttgattatggagcaaagactaacactggcaatgctttgaagtacttgagtcaaatgggtctctcatgtggtcattactatactcactctcaggctccagtgcaaattgtttccttacgccaactactcttgctttcttttaatagacctattcctcctgggctgtctgaaactaacatttcattgtaaataaagtcctgcaaatccttggtatctcaaagaaccctccttccatttagttttaggagaactttcctcctaaaactctattcttctccctggagtccagatccccattccttgcaacaaatgaactcttgatttgagcactgaagggagataattggaagtttgactttgtgttctaggttttccctgccaatatatgcagcgtctttaaaactaattgggctgcggcaggagaactgcttgaacccaggaggaggaggttgcagtgagccgaaattgcaccattgaactccagcctgggcgatagagcaaggatccatctcaaaaaaaaaaaaaaaaaaaaaaaaaaaaccagcaaaaagaaactaattaggttcaagaagttcgaatgaattcaactaagacaagctcttaagcagacatgttggaagttccagaaaagacagtttgggaaaatatttttattaaaaaaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttggttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatacgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataattctcacagtaattttatgagataagttctatttattatccctctcttaaggatgaggaaactgtggtttaaagagcttaagtaatttgggcaaatcataaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagattttagtgcatagcatagggcttagaaaggagaaaatgatgaaaaatatttattaaaataattgtttttctttgatagttgttataaccatctaattgtgagtgcttaacaattactataaaggagaatggaaatcactgatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggcgtgcaccaccatgcctggctaatttttgtatttttggtagagatggggtttcaccacattggccaggctggtctcaaactcctgacctccagtgatccacccatctcagactcccaaagagctgggattataggcttgaaccaccatgctgggcctttctcagagaatttacagtttacctggaaatgtaaactatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagaaaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaatatttaatccctggaaaaaatgatgacatcacactgaaatcttgactcataagagaacttttttatgctgttccctaagtcagtttatttctacttcattcttgtgttaagggcaggctcaattcttactcattcaaaaacagtatcacctgaagcttttctttaattcttgttttctctgcagtgacaaaattaatcaaggggttaaaatgtatattaaattatatatgtattatatataaaagttatatagtatagatcagagaagaatatattgcatatgttataggctgaattgtggcctttccccaaattaatatgctgtaccctgccccctgccccctgccatcccagtatatcagaaggtggctatatttggagatagagacttttaagaggtaactaatgtaaaatgaggtcatatgtctgggtcctaatccaatatcactggtgtccttatttgaagaggaaatttaggtacagacaaacatgtgcacagaaaaaagtccatgagaagacaagatgagaaaatgactatctaaaaggcaaggagagaaatttcagaataaaattaacacatctgatgccttgacctcacacttctagcctccagaactgtgagaaaataaatttctcttgtttaactcatccagtctgcagtaattgttataacaaccctagcaaagtaatataggaagtatatatatatacacatatatatatacacacatacatatatatatacacatatttgtgtgtgtgtgtgtgtgtatatatatatatgatagagtagatagatagagacatatacagtcatccctcagtattagtggggtattggattcaggagccctgcatataccgaagtctgcacatactcaggtcctacagtcaaccttgcagagctcgcatatgaaaagttggccctccacatatgtgggtttcacttcccacaaatactgtattttcaatctgtatttggctgaaaaaatccacctataagtggactcacacagtttaaaccagtgttattcaaaggtcaactgttgatatatagatatataaatatctcatatgtatagagcaagcaggagaaaaaatctctaatctctcttccttcctgctctttttggattgcaaactcttctctcataagtacaaaaagtaatgttaacaaaggaaagagaattggaaatagtagtgtttttgaccactagtgttttgtaattttagaaaaaaaaattactgaaatgtaactttttatttatattgagatgttttgactcatactccaatcatacagaaataatagataaaatatgaaaaagacttctttttacatacatagctggattaaaatatcagagataattttcttccctcaaaggatcccctatttaataaatggtgctgggaaaactggctagccatatgtagaaagctgaaactggatcccttccttacaccatacacaaaaatcaactcaagatggattaaagacttaaatgtaagacctaacaccataaaaaaccctagaagaaaacctaggcaataccattcaagacataggcatgggcaaagacttcatgactagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccgtctaacaaagggctaatatccagaatctacagagaacttcaacaaatttacaagaaaaaaacaaccccatcaaaaagtgggcaaataatatgaacagacacttctcaaaagaagacatttatgcagccaacagacacataaaaaatgctcatcatcgctggtcatcagagaaatacaaatcaaaaccacaatgagataccatcgcatgccagttagaatgatgatcattaaaaagtcaggaaacaacagatactggagaggacgtggagaaataggaatgcttttacactgctggtgggagcgtaaattagttcaaccattgtggaaagcagtgtggtgattcctcaaggatctagaactagaaataccatttgacccagcgatcccattacagggtatatacccgaaggattataaatcatgctactataaagatgtatacatgcacacatatgttaattgtggtgctattcacaatagcaaagaattggaaccaacccaaatgtccatcaatgatagactggattaaaaaaatgtggcacatatgtgccatggaatactatgaagccataaaaaaggataagttcacttcctttgcaaggacatggatgaagctggaaaccatcattctcagcaaactatcacaaggacagaaaaccaaacactgcatgttctcactcacagatgggagttgaacaatgagaatgcatggacacagagtggggaacatcacacactggggcttgtcagggggtggggggctgggggacagatagcattaggagaaatacctaatgtaaatgacaagttgatgggtacagcaaaccaacatggcacatgtatacctatgtaacaaacctgcatgtggtgcacacgtaacctagaacttaagattaaaaaaaaaatttcttccctcacgaggtacaaagccaagcattacactggggccatgatagtccaggttgctgaaagatttagaactaaagactgaaaattgggatatatattgagagagagagagagagaacaaatggtaacctaaatttaataaaataataatagacaaattagggtaacaggcatatgagtattttttgttctaacaattcttttattttcaaacttatctataatcttacatttatttcccaataaaaaggattttaagtttaaaaaagaaagtttttctgtagtaacattttcacaactagggcctttaagactgaggaaatactccaagctctgagcaaactcagtaagtataaatccatatgtagacataccacagtaaaatgcaagatactaaagactaatacaatattttcaaatcaaccagagatggaaggcagattacctacaaaggaaggacaattactttatcacagacttctcttcatcaacgagaacagacaatacaggaataacatctcccaagttgtgagggagaataacagatgacatgaaattctacaaccaaataaagcataattcaatgggcagcagttaacagaattaagctgtttccagacatctatggagatatttaactcaaagatgtcactgtaaatttgattgttgagatgtagtaatggatacttggtaaggttattgaattagttaaacgatcttcaaagcttaggtcatgtatcttccttaaacacatggtgctttgcatttactaaagaagggcttctgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatagtgtcaaccgcatagcagttatttgattggcccattcctttataaaatattttatgcttagatgatgaactctacataaattcagccaggagaatgttttccttggcaatctctgggagattacaaatgttacttttttttttttttttttgagatggagtctcgctctgtctcccaggctggagtccagtggcgcgatcttggctcactgcaagctccacctcctgggttcacgccattctcttgcctcagcctcccgagtagctgggactacaggtgcccgccaccatgcccagctaatttttttgtattttagtagagacagagtttcaccgtgttagccaggatggtctcaatctcctgacctcatgatccgcaagcctcggcctcccaaagtgttgggattacaggcttgagccaccgtgcccggcctacaaatgttactattaactcctccttctgctaagaaataaaccaaaataaaattattcacaaatataactgttttgatcatgctttcagatgatatgtaaggtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccattgtgataacttactacataaaagtacaagttatattatataaaaagacagaatggcctggctcagtggctcatgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttcaacctgggagacggaggttgcagtgaactgagatcgtgccactgcactccagcctgggcaacaagagcagaaactccgtcccaaaaaaaaaaaatgactccaagaaactgaggtttctagatgagggttacacaatgtggatctaaaagcaacagggaaaggaaaaggatttgggcctagaatgtggggaaattttagatgctgcagaaagccttctggtgtctttctagaatggctggattttggttaagacaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcacaaaatccagcattagcaaagaacactgccaagtttaccaaataacccctcattctcaatatctgatcaggttcttcattcttcaccattctgtaggtgatgtctgatcaccctggccagtcttcagcaagaattcttttagggcagtttagccagaatctcccttactcctgatgtttcctcttagtgattctccattcactgacccctgcattgctcctgggctataaattcccacttccccttgctgtattcagagttaagcccatctctctccccagctccaagactgtgttgcagtggttcctatatctatggcaatggtcctgaataaagtcttctttactgtgcatttgaagtatcactgaataattttttctttaacaattatggtgttgaaacagattcatcactggatcctgggcctctcactcaggaccctaaatgcatgcctttgaagtctttgttgtcatttctgactgattagggatccattggtgaatcagattcctgagccattgctccagacaaaagcccgttgatggctatggacagattttgaatcttaagggatgaatattctctctgaagctggggtagagtcccaggcttcttttgaaaggaatcctctgggcaggaaggtcttcctgtgggcttcttgttctgagtgatctattctctgagtccctagactagaagtctcttccttctggctctctttttctgagtgaggggttattccctgattccctgagctacaaattgttcttcctggctctctataaaaccactctgctctttctcttctctctattggatcctgcttctcccatgggagctctgtcacctgaaacccctcttctcaagtctctgctgactatttctctgtccactcttgccagacccgtttcttttctgctgaacttcaggacccctatcctaccctcctttgagggggctctcaagggactcagaggcccctcaaaaacaagcacctggggctgataataggagaaaaaaagaaactatttggaaactgataaagtaaaaaaaaaaaaaatcttaaaaaacctcctccacaaatattggtaaaaagatttagcctttgttatgtaggtcaactcaacttatccctttctcaccagaaacacaatttggataacaatataaagtggagataaaccagtgagtttgtatttttgtattactctgttttactgcctcatggttaaaaacttttttttttttttttttgagacagagtctcacttcattgctcaggctggagtgcagcggggcaatctcggctcactgcaacctccacctcctgggttcaagtgcttcttgtgcctcagccgggcgccacgatgccccacgcccagctaatttttgtatttttagtagagacggggttatgccatgttggccaggctggtctcgaactcctgacctcaggtgatccacccgcctcagcctcccaaagtgctgggattacaggcatgagccactgcacctggcctggttaaaattttttaaatgaaaagtcataagatctggttacatcagtctatatgtttgtgtatgtgtacatgtgtgtatctatgttattatgttatgtatatgtgatatttttctacctccaacgttattaccaaactaaaatacccaaattggctagggataaatgagcactcaaacaaataagaatgtataaaattttcagaaaagtagaaactgacccaattttttttaggttcacataatctgggatattccttagtaaataaaaactagtttaaaaaatattggtaaaataaaaatagaaacattttcagaactgtcagcatacacttattttacctggctttgctgattagacaagtttgtgttgttactgttagatgtttaaggccataaaaccataaattcaacctaagaataggatatgtagtaaaagtaaattgcttaattgtctggtgtatgtctgttgcaaatgtaaataagaaaacatatctagaaggattgtgaaaatcttatcttgtatggtctaagctgactgagattggatagatttatttataaggttttattaaaacttagttttagtaatacattgattcaaaagtagaatttgatcttctccgttaaaatggtaaagttttcttggaatgttggtctgagaatgtaaagggtatttttttccttttaagtaattggcctcagaaacagagactgtttcatcaagataatttcttgagtttcatgttgttttattaggttttggttacttaagaaaagtgagtcttctcaatattaaaggagctaagttcttgttcacaactatgtaatctgaatttgcctttaaaatcttttaatggagcttttattaaatagataactatggtcatatttgttttaaatgttttaaactttttgacatttttgacaatcttcccaaaatcacattctaagttaagtctttttgacctcaaattaacttaggattctccatattggaccctcagaaagccacaaagaatatttttttttgtatgaaagagagattaaaccaattagatttatttaatgtgctaaattatatgtgtagcattcaaataaaaagtgatgctaagccatctttaagttatatttatggatatattattgggataagtgtacaaaagttgtatgagattcctagaaatctagtatgttaacagtcataattttggttattatgttaaaatgctgtatgccatgctaaccaaattttcttataaattgcatcattgtaatgaactctcattagattttttaaccatggacattttaagtccttgtcatctgtagacagtcattgttttaatttacttgttctctaaaagcatttgaaattagctacagtccaaaatggcttcttcttcaaggagatttatggaaaatactcttatgagtattctggaatacaggtttctgaacaactttaacatcatacaattggactggtaagaatttccagaactctaataaaactgacgggttcatgtaactactaacccaagatcaagcaaaacaagatttaattacgtggtactgaatgaaatgatgagaataatttttaaaatgactttttgttggaaacattgctagttctttaaatgttttgttttccagatttcagaaaacttttttttaagctatctctagcttacaccaattcagtaaagaatacttttttgcaaaatggaaacatttactttttctccctaacttatccctccagaatttggaaactatttgtgcatattcttatttttatggcaaagtatttatttgcataagtttaataagaatctgttgtctttgtgacaggacaaactggaaacacaggttatatcaccaaggctttgactgaaacatcatgttttcagatatgaccagaaggctttaggggactaaggttggctttatggaaccaataaagtaccatcttggaaaaactggctctagggttcccagacttacaggtaaataaagaatgtcactgtttggcaggtctggaaaccttgggatattttagggacctcaagaagagagaaatttatctgaatctataaatgtaacaggtgcagactaatgacaagttttgggcttgtatcccagcctcaagtggcttttaaaagtttaatctgactggagacagtggctcacgcctgtaatcccagcactttgggaggccaagtcaggtggatgacgaggtcaggagttcaagaccagcctgaccaatatggtgaaagccctgtctctactaaaaatacaaaaaatgagccaggcatagtggcacgcacctataatcccagctactcgggaggctgagcagaagaatcgcttgaacccaggaggcggaggttgcagtgagccaagatcgcaccactgcactccagcctgagtgacagagggagactctgtctaaaaaaacaaaaacaaaaagttatctgagatttcttatctgacaaacgcaacctttaaaagagcctaaatggtcaatcactactcttaactgcacttgtgtacataaccagtacaagtttaatgagattaaacttatttagcaaacaaatcaatctgactttgattatctttgacagaaatgagagtgaatatagagagaaaagttatgtttcgggagaaaactgcagtgcacccaatattagattctagctgttttttttttttttttcctgaggttttattatctgcctgcaatctgcaatagatcctcaatttttctagtttactacaatatttagctacaatactccaaattaatatttcatttttttcctgctattctggcttggaatcactaaaattataaacttttcttttcttgaagtccttcaaactgaaactggatgacttgacataagcttcagaaaaattaccacaacagcttgtgtgtggcccatctttatggcattcaaactgcaaactaatccaatgcctcttctcactccagctgaagatattaaaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatactgtttgaaggaaagatgaatgtctcttctttccttaaacaagaagtagtactaacaaagattccttgcttggccaaactttagtcagatgtctatcttccttgcaaaatccaacttttttttttttatgtcgtacaatgtgatgttttgttctttttaaaatttattattattatactttaagttttagggtacatgtgcacattgtgcaggttagttacatatgtatacatgtgccatgctggtgcgctgcacccactaactcgtcatctagcattaggtatatctcccagtgatatccttcccccctccccccaacccacaacagtccccagagtgtgatgttccccttcctgtgtccatgtgttctcattgttcaattcccacctataagtgagaatatgcggtgtttggttttttgttcttgcgatagtttactgagaatgatgatttccagtttcatctatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgggtacctacccagtaatgggatggctgggtcaaatggtatttctagttctagatagaatgtttcctcttataactcatagtgaatatgactggacaatgaaactattttgtaatttctttcctgaaagataaaggcgttagaacatagaatctttcattgattctacagaatcttaagactccttcagagatggcagtcattcgtaccgtgctgaacatcatgttgtcacggtcagaatcagaactaaattgattaagggtctgaaacagtttggcactcttgggcacttattctgataagaaagctgatgagacagggtaatgaaaagaggctgcaagaaatgaccattcatgcattcagccaacatttaggccaccctcctgtattccaggcactgtacgtggcactgagaatgcaaagcaaaacgagtcatggtctactggcgggagccttctcagcggagaaaagaccaataagaaaagtgtctgctggagacctctcctagggcataaaccaatatagaggtggggcagctacgtcaccctgaggtgtccttaggcagaacagaaagtgagaatcagagcagtgtctcatttctgaacacctggattgtagctttccctggactgactgtcaaaggaggtggttttaaaaagcaagccaaacaggtttccatcctttaggaagaccctggaatgtgccagttgattctgacaatttctcatgaacagaaacacctaggaagggagaactggtgagtcttttcaagaggaggaagtccctcaaaaggggctgtgtttcgcaaacagcgccccaaaagggctgaaatacttcgatctggaggaaaaagactcaggcactgagggaaggggagggtgcacatctggagtaatttcaaggctttttccgtgttatctgaggtggcaacaagtaaagatttgttcgttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgacgcctgcctgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggtcccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttcccagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccacgtagtgcccaaagcctgcaagcacgcctcctgggttccagcagcggcggcagagcggggttggttggacccaccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccaggagagagatcggattttgctttcgctgccgcgagccgggctggggctgcttccggcctccccgaccgggaaattcccgccgttgccatggcacccggcacttgctgccgggggcggcctgccgctgcacccagtcgggggcgcgccgcatcccctgggacgctgcgcggagagacctcgccgccctctagccctcccctcccgcccggccaggcctcccctgactccaccaaatggagggcccaagtcctgatcggggttaaaacaaatccactccaggggtagcttttgacaggactttctgtttcagatttcagatactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttaattttcctggtgagttggggctgcgtatttccatgttttctgaaggttcacataaacatgcagcctgccaattctctgtatatattttttttcaatgagtggtatttcggttttcacgtttagttgtaagacagaaattggagacttatatgtagctggagtggatgacttctttcttttgggggaagaatgagagatgcacatttcgttagtaaattgtgaacaacttgaaacaaacccaaatccaattgtgaatttaagaagtagagttaaaatgaaaggtagccattcaaatactatgccttgctgccttcacttattaagttaggattttcttccttttagccctttagggatacagtagtttaaaagagcagtagccacatatgaaaggatcagatttagcttagagggaattccttagaccagccctgctgttaagacttgacattcaatattgtttgatcacattccaaaatataccttagctaatggcaacatttgtaaacatataaattgcaaaagaagctttcttgtgtacatacatttttaaaagcttgaaattgatgtgaacttttaaaaacacgtaggatctgtattacattctatatctcaaaacaaatttaattaaagtgaatatcattccagtatatacaatatgcctaagacccagaattggcacactgatttactagttgaaaatataacagtattcaccaaacttcaatgtatactttttggagagaatgaaattacagtatttcttaatttactgtaatgtcatctttgtaattatgaattaacaattcaatgagaggagacttggttgattaaattaatgctggtcctacacattatatctaaaggatcttcgtatatgactactatcttcttggattattttaacagttaaaatatacaaagtggcccattaaaaacagagttgacttttcaccattgctgtttttctggtgagacatgtggaaaggaaggacaggtggacttttcaactaactagctctctgatttttaataagatacctcagttcttttggcctcagtttacttatctgtacaaagggtaagtcatatgcttaatcactaagatctgttagatactgcagttaagattctttatcaacaaattactgaactctagtgttaacatagctagaggtggaaaagggagcaagaccaggtgttgggatgaataattaactaatcgagataacatcagttttcaccataggaacaagtaccatggttgctcttaaagtaagagatgtttcctattttatgtaattttactaagggataatgttttcttttgtcactgatttaaatgtacctggatgtttctcagccatgtggctaagatcgaacacaagtaatacctgggccttttatatctaatctaatgtagaccagcctgttaaaagagaaagacaattggttaaactgctgatgtgttgctttgtcttctcaaaagcttgttctataatacaatatgtaaaaagttgttacagtgtagtaaccgtagataatccctttatgatttgtacctaatgacgaagaccttttattttctgaaaataacatgtttgttttcattaccgacattagaagccaatatttattaatctatttctcatcctgacatttcagtcagactcttaaaataatcttgctgtgttttgatttaatgtgcttatcaacttataatattgaattaatgttaatagtgtcattttaggtgaactagacttcattgaaggaggtgggagccttatggagagagagtatatgattatctctatttgtatttaattaccatttcatctaaccgttcagaacatatttcaagaataattttaattcaagttgtagataaaacttactataccattttcattttgacgctttccgagaatgagatacacggtattttaaagacaaagattgatcttacatgttactattaaaaaaaacacgataattttgttctacatttatacttttaatttttctgtggataataagaaatgccaagagtcgattgtgtccatgctggcaagtggcctaataaattgtccttttatttggtggtcctcagagtggcagttaacatcttgctattctgccttgtggacttgaggtggaaaggttcatggaattatatccttgcttttggatgtgcaaactgaggctcagagagtttaagacacatagtcactttcaccaatcaaatgatgaagctgccatgtaaacgtatttcatcacactcccgagaccttcttctccagtagtgttttcaagctttttgagcatgcagacactaccaatcaaaaaattatgtagagacatacttgagagttacagtttaaagaaaaacaaggtgtaattatttggttattagtaacatttacatatgtttgaaaacttctgctatatatacagtaagattaatttattctaacaatgatcttgataatccccctgattcccagactccttggaatagctccacagctatcagtggttctgccacaggttcagagccttcccagtactgccttcttatttgagaggtgtgctaagagctataaagcagaggcttcaattgtacacaattgggaagtttaggcaaaagtcatttcttccctatattttgtcatgcttatctcctgtctctttctgttttacagattagcaataaactccttaaaacccaaaggtttgggcttctgttcctttcacttgcagtcagacatggagttagtggtagaagaaacagaaggggtaacctgcatggtgacagctactgaggggatggataggaaagcaggctgagtccctggggccagtggttaccaaagccaaggagagagcaaggggagcccagtgggcctggccatggactgctctggaattccgagtgtgaactttcagccaagaaggtagtgtgaaaatattactgtgaggttttaaaagtacacaaataacaattgttttttgtaaaaagaaaaaaaaaaagttagaaaaagagatatgccaaaaagaagaaagtaaaaaatacatgacttctgtcttctgttaacatattaaaatttatgcttttagatttttatgtgtctatatacatgtaaaatatatatgcatccccaaattgtattatactcttttgagacctcacatttttttcacccaagaatataatattaatttctttcctttagaaaagacatgagactaaagaatgtttattgagttgagagtttcccaatcaaggagtatgactctgtataataataaatctaatgttttattagaaattataataaaattagaaatttaatatttggcaggatgtgagttgcctgcatatgtacaccctttattatatgactagacactcttttgtgtggtcatggatatattggcatcttttgaagtgtatcctttttgtttcaggagcttctgtctagatgaatagcaagtgtgacactgataatagtaatcgaatattcctccaagtacaggctccttcctctttctcctggacctttgcacatgctgcctggaaaactcacccacaacctactttccatcctctccttcggctcatccctgctcagccctctttgttgagatatttgccaagccagattctctgagaagcctttcctggcatcttcgtctatataattctgctagttgtttctaaaactatgttgttagtgtatattgtaatcacctatttatgtctgtttgactgtgagcctcttggagatgggaattctctcctatgcattgcggtttccccagcccctagcacactgtctagcccagtattccttctcagtaagtaggtgttgaatgacttacaaaatgaatgctaaaagacctggtagacaagaaggaatttcttagcctaaatgaccagatgtggagaagatactcaaacacttcagggtccccaatctggtgatgtcacttgcagtggaatttcatatgaatccagtgtgacagaagttgcctagtcaagttgtaagtcctcttctctgggtcacatgttcaaatacttttaggggacagataatgcaatatttaagatacaggaagtgatgaggactgtggcacactggagagtttggactccaagagtaattaattcagttgaaaaaatcaacagcactctgttgatcaagcaaactttctaagggccctaatccacctgggcctgcagtatgtaattccataactcatgggatgccatcaagagagacaatctacttgattgttaaagggcctttgttttctttggagttccccaggaaggagaaatgtatgtgtgtgcaggggtgaggagggggggagagtgaagaaacaatactatccccttaaaaagttttgtcagttttcattatgaaagaagatcaaacgtgcccactccagaaatcttggcatatgcagttattttgaagccattcagcgttcttcaagatgtcacaatgaaaagagtgatgattttttaaataaaaaattaacatgtttctcttggcaatgggactttctcaccatacttttaagttacatcacttattatatattcaaaatactgattttttaaaagtatgttccttggagccctgggaacctgcctcaggagctgaggtggctgtggggagggagtatgaagggagctgaatgagtgagaatctgggtcttcatatcttttttaaaattgtggctgcttttttctgttatgtataacaactctttttgaaaacagtttcattttgagttttaaaaccactgacctaaaataaccaccaatttaacgtaagtataacttcattgagtttttttgtattaaaaaaattaaactccattttcttcatggattaaggtgatcctactaggatatttattaagcattgtctctgctgttctttttgcttgccttgctttatcccgtgtttccaaaaaatacaaataggtattttgtcagctattttacattttatagcagggaaaacagaggcttgggtgatttaagtaagttacagttagtaagagccataggatacatttcggtgtaagtcaatgtttatgtaaggcttaagagacattggttgaattggcatgactagaatagttgagaatgtttgggaatggggagagattgctaatgggatgtctgccaggggcaatactgaaaatctactggttggcaaaggtagtgcctgagcccagtgctaaccatagtagttggaaaattgtgtacgttggctgtggaatccttatgcaaatatttgtccaatccatctaaatttctctctgcagcatttttaaaaagacatatagctgaaattttgtcagtcctaaaaatattttgtatttctctgcccagatttgcatttgggtagatcgtgctgtagaagatatatcttgctttgagatagctgccactgaatagtttagtctattttaatcaacttattgccttgtaatctttcctttttcattctctaaatttctgaaattctatctttcatgttccccaggaaagactagtaagacgtgtttttattaataagacattatcctcatttcaccacgacataatttgggctttctgttccaagttatcctacttgaatgctggacacttccacctgaatatttgtcattttcacctcaacccagcacatcaaaacaatcccttattacctctttaaaagaagcttctctctccagccttttcctagtcagtatcacatcttttgagccaggtatggggattgcagtttcagatttcacctcaagtcttcctcttctggttcctgaagctccggcaacctctgctttgaaacattgttggcctcttcatcccatcccatgtcaatatttagcccatgccctgttggctttgacttagctcaatcaccttaacccagtgtcttaaaattcttgattttgagtttctcatccatccagtttatttacacctgaactctttaagcatgaaattaatcattcttctgttcagaagccttcgaatgtgaccacagctttttccatatagacctaaaacttatattcttggcctttgagagctgccttccctacccactgatatatgtttctcgtgcttcctaacacctacatgcttctgtttgcttagtgaccactccccacccactcatcagcagtttgtattaatttagtgtaaagctgtgtaaagtttattgattgataacatctgtgtcaagatcatggtttttattataaagagcagttcattgtgttttttccttgcccacgaatggtatctctgttcattaggatacataatattttatgcgtaggaggatagtgtgagaatatgagtagaacaaagtaagaatgagaggagagaatagtgaaatttgaggataggatgagaatgtgaatagatttatgtccatccattacaagattaataaccacaacgataaaagtcttgaatgttatttatttgcatatgagtgatatttcagtttgtggctgatacccttttggtattaaatggaagatgacaaatcattcaatattaattttagagggagacatctattgaaacctttgtgcagtcaggtcaagtttctgtgtacaaaaattagcagagaggttgctgctggttgacctcccctaggatggtgtctttctgaacattttgaaatgtagattgaaaaggtggatttgtcaactaactctgaagtgctgtagttatttgtgttttcatcgttttattgtttattttatttttaaggtggagttttcgctcttgttgcccaggctggagtgcagttggtgcgatcttggctcactgcaacctctgccccccgggttcaagcgattctctcgtctcagtctctcaagtaactgggattacaggcacacaccaccacggccagctaattattttgtatttttagtcgagacgagaactcaccatattggccaggttggtctcgaactcaccatattggcctcaggtgatccgcccgcctcggcctcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccaggaaaaaaaaaaattgtgaagcacagagctgcttaaaagagtgatgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccagactgtttaattagatgttagatttgtagccaaatatgtctaggaaatgcttaaacaatataaaacagttttaatgattggctttttagaacgttatatattagtgtgctttatgcgtatccaagaggtgagtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactgattcacattgagccatgaagaatttattttcagcaatttttatagaagttgctttatgacaaagaaagctttggttaactggcatttggcatttcacaccactaaattttctacatgtggatttatttctctggttctctcactttctcactcagttatactgaattcatttatgatgagcgctctcaaccattcttattcatcaaagccctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaatgagagtatctatttggtgaaatcattttcctccatgtgaccaaatgagaaatttagtgaaagatttaaaatcatttttcagactttttccacattagtcgggaagcaaaccccttttttaaggcaatgtcagttattaagctttagggaaccacatgccactttaggtaacacgtgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaaaaagttagtccctccagctgaaaagcggtcattactttattatcaccacagaatttgaaatgatttctgtagttaacagtcagattttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttttgtaatcatattactagtttcatttcatatgaacttcctttgttgactttctttgccattaatttaaaagttccagtatcctcaatatttgatgtcttatatgtacagaatcctttccagctgtaagtcatcagcaagtaaaaaatttagtatggcaatagttttcataagaggttttttaaaacagaaaaatgttgacattgccagcctctgggttgcattttgggatatgctacatttcaaaggtatcttttaaatctgaaagcaaagactttttcaacatctgaatattctgatttacagaaatttaaaaaaaaaacccccgaacattacacgggcatataaatttgaatcaggaaaatataaaattagctgattatttttattcagtaaaagtgccttggcacagaactaaaattgataacttatggttttagcatgtagataagtacatgagagtaaatcacatttctatatgaatagaaatatccactttattcatgtatagattataaaactatactaaacaaaaagtaatcatttactattacaaaaattattaagaaccattacaaaaattctctgcctactaattttcaatcaccatagaaatacagtatttaataatgctgctgctgtacttacataaaacatattaagaatagatgttatatttctgtgtttgaatattgagcttaaacataaaacatgtttgaaatgtgtttgtgtgtgtctctcacacacacacataacatgtacatacctgaaactcatactgcaattgcaacacatcttaagtttttccttttaaacataccaagataacattctaaaatgaagaataatatctatgtctctcttcctactacatactatctctctatgtatatgcaattgctataaacatatcttcatatttgatatatataggtacatatatatggatagataaatatagatatatgagagagaaatggagattagagatctatgtttgccataaatcatacttgttaacataaaccatctgattaaactgatattttgtggcccaagacctgagacatgcaaaactattcttagcagatagaattttctaaaagctgagagctcattctccaggagctggccaaggaccagtcctaaaggcagacctttcttggaaatgtacagagtctgggcaaacaagacctgctgagttaaccctttcctatacatatgcagacggtattcagcacagggcctgacagaaggcagtgtttgttattattattcatagcattagcccatttcttgttgtgagcaacatgaacaaggagactaaggggaaaaaatgcccttttttagggtgaccaccctaactgatttgaaagtctacaattttttcagtttaaaatggtatttatttgtaacatgtactattgttgaataacaatttctaataaaaaaactacgctagttttctgcctatggagaagccacctttttattcttttactttcttaataagcttgctttcacttaaaaaaaaatctaccctacatatacacaaaagttaaaaagcagcaatagtgtacattggtcagtataaatgcatgcagttttcttttcttcagtgtacaaagtccaagtctaaacctttataatttttagagtctagcgattctccagactccatacttttcgttgttatcagatgccagcgttaattgcttttcctttcttctgttttgggttcctgatcttcatctgtgtctttaaaacagattattttctttagatttgaaaggttgggtttttgtcttcatatcttatttgtttagccttgtatttccctttctttaattgaattgtgttattgaaaattaaataatttatctgtgaagtcaaaaatcctgtttcagggtgggctctagagccttcctcttgggccatatccttagaaagcctgtgtgtattctgatacatttggcaatttctactggcttttcttgtgttgtctgacccctttttatttcagcggtgcatcctggtcttacccaacaggcaagtggtgactccagtgcaggtgacgcagaggtgacactagaatgaagtgaaatattctgttgagggctaagttcatgtttttgctgacagtggtggataaatgtcatggcttccccctgcatagtgcttaggacatttcttttgatatgtgttttagagaaaacataaaacttgtaatcaggaaaatgcaataacggaagaaatgcttacttgagtaactaatgtgagttaggcaaagaagatacaaatacttcccatttcctacttctaaattacagtcaaattgtcctaagcaaatctctcattgtctccatgtaaaagatatagagaagccattagaaaaaggtggctggaacaactttatacatacagcctgaatgaactgcctcatcatttatatgtttgaggaaagtgtctgtttgataatttaaattaagtttaaactgtcataaacggagagctgtacagattctgtgggagaggatactgaggtaccagatactcattactaggctctccactctgccttcttcaatactctggatcggtgccctttattcatttttttcacaacttcctcccctttgctcacattctttacaagcttccaggattttttaattttattttatttctttccacaatgactctcatggctgttgctatagttgctataaaaggcaaggtggggaacagacaggtgaatgagcacagaggtcatttgtaaaccgtttgtggttagtgctcctctgtttactgtctgtctctctaagtgtctctgggtatgtgtctgtttacaacataaaatatatgcacacaaatctccaatttttctagagtaactattaacacagttaaaatctggaagaactctatcttttaaaggaaataccaattagcaaataaaagagttgattccccccaactctcattccccagagcttgcttaagtgtatggtttgcacacattccctaaataaaaacattgctggctcataactatgcttcactttcataagccttccaaatgttagtaacttagccttctccttttgaagggttagtctgtaagtgatactggaagccatgtggtaagaaagaggacagaagtataaaatcagactcagaaagtaaaatctggcatatttggcatagatccattcagcttcgtatactttgttaggacccgagggcatgcctgattttcataaaatcgatgcactcttattaaaacaaacaggtgaaaatcacttttgttaaactacttgacaaggcatctgactaccttaagtgtgttataaattttgcaagtggttaaaattttatgcttatgaattcaaaagatagactttagttaaattaaaaactaatttatgtagatattttccctaataatatagcacaaatgggttttatttccaactgaaaagagtgtttattaccatggatataactagaagaatcatacaaatatatgtaattccattagaaaatatttttgttaaaatttgaaatgacaagaacttaatgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactattatttcatatcctttgacttacaggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaactaacattttgccaagctaaattttaatgaatttatttggacgtttttataatcacttaatattttcagttcatgtgctaatattaactctacttactggagagaaagaaatggtattcaatatgataactgccttgttactgcagaaatgtagaagtttggcattttaagtatcaaatattttaagtcaaaaaattaccagtgtcccacagcacagagagagaatatatgtttgcttgtgtccctttaatctttcccctgtaaaattaagcctaggggccttacactattttaaattttcaaaattaggtcatgtaaatgttgtgtcagatttccaattcataagtagtatacttatgaatactgaatagtgaacatagggtacatttatatcctgctgattgcttagctgtggaccagaggtaaacagagaatgaatggtattttcacaggttagtaaactgtttttctatgatctcttatatacaagtgtgattaacattttttcccccttcctgaactaatataggaacatatggtctaataagtgtgagttcatttggggagggcaggatagaatgcttgaaattaggactgacccaaaaaatgccttggtctcagtatttgtggattacgaggaggaagggctgaaaaggaaccttaaaagcattagaatggtagagtacagattagcagcaacactcagggctccatcatgaagagagtgagatgagttcccatggttaatgcagcaggggctctaattgaaagccctctacctaggaaatgatttaaatccttttatcctagctggattgtgaacattttatttactttgaggaagttgtttaacactttttgtagattgcatcaatatttagagtaatgtaaatacattttccctttggctattttacaaggacattgagaattaattaaatttaaaagaaagtagtgcagttaactcccaggagacagagggagatgtttatcatttttctcatcattcattccttattcattcattttacaaatgtttgttgaatagtaattataatgaagatactataccagcttcctgaattgggaatacaaagatgaaggatgagagtgacttctgccttcattatgttatgtgttcatattttctttttaaaattctcattataatatgagtaattgtgcagggatttaatattgctggtctcagcaatagttgatctttgattaacatctcactgacacatattttcactgtgtatatttatttttcctttctaaatttagaactactctttatcttctactgtaagagatatacaacatacttttgtttttttctatgttgtaatctgcagtttttttaaccaagaataaacacaagttctaatagcaaacagaaataaactccctacacattaccttctccattaaaatatgttttatgccacatgcagaattttaatattatatagttatttgtgaaagtataactaaatagaaattttaagaaagaatgcctctaatattcatatcttagcactaaagaggcatatattattctgcagattgaattaaaatgttagttaccaagatatgaacttagacattttcagtaagcatttataggctattctagtggaaaactgtacacaatttcccatgaggctggtgaaggtttcttagcttaagcgactttttagctggttcttggattttattaaataatatttgaatgaacagttttgactaacagcctgaaaatattaatctttcctctcagtctgagcaagtgaaagtagataaattcatattgtatgtctgattctctttgggtttgaaaagaaataaagactctacttctaaattagcatagaaaaaaggagaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttttatatatattcatatattctcttcaacatacataatgtcataaaaaggataaaacgcctaagtctagtcttgacagagcaccagcttaaatcacatgcgcctatcagagaacttatgacaatatttagggctaaacttatgttactggtgaaccagtatctggaatgatttccataactcacttaacttgcacatttataatgtggactttaaagaataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacagtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattccaaccggtgtgagatggtatctcattgtggttatgatttgcatttctctgatggccagtgatgatgagcattttttcatgtgttttttggctgcataaatgtcttcttttgtgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcatcattctcagtaaactatcgcaagaacaaaaaaccaaacaccacatattctcactcataggtgggaattgaacaatgagatcacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaaagcaattgcttgagactacttcactgtaagctcctttttttttttttaaataaatgcagattttatgatattcctgatcattctctttgcacttagttttaaaatgttatttgcagttgattagagagtggtgataagtaagccaggatttctggaatgccagggcactgtccccatgcatggaaaactgcacaagagcttgtgtgtcttgacattcccacatgtcaggatgccttcatttgctaatgacagaatacccaactcagactggattaaataaaaggggattttcttgcttatttaactctagattcagtggtaaatgggtttctgggttgattggtttggggcctaacaatgtcttcgaggacttggtttcttttcaacagtcagcttttgccttcctgtgagctagcattgtttcccatgggattgcaaggcagctgcatacaactcctgcagttcttccttttccatatccagagaggggacgtcctttcagacgctgattattttaggtgtaaattccatgtcccatcccaaaacaaacaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacataaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcacaactggcattacaacagagatcttaagactttttgtagcaataagacaccaaattccagcctgactctagtgtagcattacatgacagatagcaggccctgaaagaaataaaaatattttaccctaaaatatattttttatcatattttgaaatgtccctacaaagttgtctcttgtggggaaagtctacatgctacagggaatccctttccaggtcttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccaaagtatcagaaaatgatggctggtaactatttaattatgcacatatattagtagaatttggggggtgggcacggtggctcatgcctgtaatcccagcactccttcaggaggctgacagattgcctgagtccaagagtttgagaccagcctgggaaacatggtgaaaacccatttctaccaaaaaaaaaaaaaaaaaaaaaaaaaaaaaaaaaaaaaaaaaattagccaggcatggtagtgagcacctgtggcccagctactcaggaggctgaggtgggaggattacttgagcctgggaggtgaaggttgcagtgacccaagcttgcaacactgcatttcagcctgggtgacagaggaatgggccttcactagacactgaacctgctggcaacttgatcttagactgaccatcctccataactgtgagcaataaatttttgtggtttataagttactcactctgtggtattttgttatagcagcacaactggattaagacattaacctgaccttaagaaatcatctcaaatcagtcttggctttgatgagaaacaaagggcacactcgaatgtgtgatttaaagagaggttttttttctcttttgagatggagtctcgctctgtcccccaggctggagtgcagtggcatgatctcggctcactgcaagctccgactcctgggttcacgccattctcctgcctcagcctctggagtagctgggactacaggtgcccgccaccacacctggctaattttttgtatttttagtagagacggggtttcactgtgttggccaggatggtctcgatctcttgacctcatgatctgcccgcctcggcctcccaaagtgctgggattgcaggcatgagccactgcacccagcctacagagagttttatgaagagaatatttctaaatatatggacaggatcaaaataacccaacaaaggactgagaggcgctcagaatctggaatcagcagagaagttgtattgcctctaggacttaattgttgtataagtctgttcaggttgccataacaaaataccatataccaagtggcttaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcatgaggaccccactctcataacctcttttaaacctgattacctctcaaaggccccagctgcataaaccatcacactgggggttagggcttcaacatttaagtgtgggagttggtgttcacaattcagtcaattggagtggaaattgaaatgggaaaggaaagctatagttactagagagagctattgtcttggggaggatcactggacaggactatggtctttggagaaataagcgagttacaactgacaaagattctttctgtgaaaataagtaatttaaaatgtaagttgttggaattccaaattactgtgagccttaaaaaaatgtgagtatgggccaggcaccatggctcacacctgtaatcccagtactttgggaggcccaaggcaggcagatcacctgagatcaggagttcgagaccagcctgactaacatggagaaagcccatccctactaaaaatacaaaattaaccaggtgtggtggcgcatgcctgtaatcccagctacttgggaggctgaggcaggagaatcacttgaacctgggaggcagaggttgcagtgagctgagattgcaccattgcactccagcctgggcaacaagagtaaaactctgtctcaaaaaaaaaaaaaaaaagaagaaaatgtgagtatggagcctaagtcacatgagaggcacctgtaaactaggcagttgtaacctttgtttctctgattatagattggccttcttccttacatacattgttgggttttttttgtttgtttgtttgttttttttgagatggagtcttgctctgtgggccaggctggagtgcagtggcatgatctcggctcactgcaaccttggcctcctgggttcatgccattctcctgcctcagcctcccgagtagctgggactataggcgcacaccatcacgcccaggtaattttttgtattttagtagagatggggtttcaccatgttagccaggatggtctccatctcctgacctcatgatccacctgcctcagcctcccaaagtgctgggattacaggcatgagccactgcacccagccacacgcattgttttctaacatgttatacaaattattgaagggtgccagggaagattgcttccctctgcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtgaaatcccatctctagtaaaaatacaaaaaattacctgggcatggtggtgggcacctgtaatctcagatattcaggaggctgagacaggagaatcacttgaaaccaagaggcagaggttgcagtgagccaagatcatgccattgcactccagccttagcaacagagtgagactccatctcagaacaacaacaataacaaaaaaaaaaaaaaaaaaaaaattctgcaactaattaatttgttgtaactcttaaagcagccttatatagaaaatgttgtgatcctattaattttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacgctgaattctgaacctttcatttatttcaggttgacatctccttggccaaactaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcaccccaaaaagggactctttcctgtttattattgcaaagccaatgtatgaaaccaagagtgagcgtcaagcagtgcaggctctattcaatggcactggagaagtaggagcatagcatggaattggagaagtagtatagcttgcaaatcaccttctcagctactgagaaccaggaagttacaaatatagaggatctttaatgaagggaatgagcaaggtgaggaatattcatgcttttcttagtaagggatggagattttcctagaatcaaggagtcacctcatttctgtcctttcttggtctcttccgttcattgtcacagtgattgtcaactgtcatgcactgatgggagtgctatttagcatggaaattggattataataaagctagatgtttttcagaggttgcgtaagctgccatcatggatttcaccagcttcagctggtttagtcccaagaagaaacttctgaccacagacatcctgtttcttaaaaataagcagagttaaaggtgagtaagaattcagccatgtcacataggcactgcaatggccaacaacatctgggtaggggtccaggtaagtcatgtaggcagtgcaataggcaacacagtcacagaaatacctatgaaaagctgtccttttgtcagggagattagcatgtgtagaggaagtacacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattacttatttatttatttattttagacagagtcttgctctttcgcccaggctggagtgcagtggtgccatctcagctcactgcaaactctgcctcccaggttcatgccattctcctgcctcagcctccctagtagctgggactacaggtgcccgccaccacgcctggctaatttttttgtatttttagtagagacggggtttcactgtgttagccaggatggtcttgatctcttgacctcatgatccacctgccttggcctcccaaagtgctgggattacaggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctgcttcttgagagacttcatctgcatcacatctgcatcacaacacagcctttgctcaccatgtctttcctcccctcaacctcccataacctgtggccaccaccccctaagaactccaagcctagttagtcctttatgtgctgcatataaacttcaaccatacggccttctttgaggcttttttttttttttgagacagagttttgcttttgttgcccaggctggagtgcaatggcatgatctcagctcaccgcaacctctgcctgccaggttcaagtgattctcctgcctcagtcttcggagtagctgggattacaggcatgtgccaccatacctggttaattgtgtatttttagtagagacggggtttctccatgttggtcaggctggtctcgaactcctaacctcaggtgatcaggatccacccgctttggcctcccaaagtgctgggattacaggcgtgacccactgtgcctggcctgaggctcatatttttatgtgactctgtattagtcagggttctctagagagacagaattaataggatagatatacaaaggagtttattaagtattacacttacttttttttgtctttttttttcttactttttgtggaaaacagggtcttgctatattgcccaggcaggtctccaactcctgggctcaagctatcctcccgcctctgcatctctgagagctgggattacaggtgtgaaccaccacacccagccaggagtttattaagtattaacttacacaatcacaatgtcccgcaataggctgcctgcaagcttaaggagcaggaaagtcagttcaagtctcaaaactgaagaacttggagtctgatgttccagggcaggaagcatccagcacaggagaaagatgtaggctggcaggataggccagtcttgccttttcatgtttttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacccgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggcccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagagagggtacaattatctatgttgcaagctagcttaaactaaatttctttgtggagtggggaaggggtagatgagggggcccccaccaatagatgcctggccactgggtgaaagggaaagaaggaaggtggagggggtggctcagtacattctgcttctttatttctttctttccaggtaggctgcctaaacctataccaagccacttagaattgaaaacagataatcacatataggttatttcctacaattccctcctttttctttttaccctttttggtttcattttcacttaaattgctttttcaaactgttccagaattgtttacttttttttttttttagacggagttttgctctgttgcccaggctgcagtgcagtggggtgatctcggctcactgcaacctctgccccccaggttcaagtgattctcctgcctcagcctcccgagtagctgggattataggcgcgctgtaatttttgtatttttaatagagacggggtttcaccatgtttgccaggctggtcttgaactcctaaactcaggtgatcatgagcacccgcttcagcctcccaaagtgctgggattacaggcgtgagccaccacgccaagccagaagttgtttactttcttcctcataggaggaggagtttatttggtttctaataatagtaggttattttgttggaacatcaggggcatctgtttactgagagttgttttaataaaccttagtgttatatatatatatacatatatatatataatatattacatatattatatatagtagtagtgttaaaccccttacacaagtattgatgcaacatcgtatgtcaatgacagaatctgataagttggaagagtatactgtagaagatacatcacttttttttttgttttgttttgagatggagtcttgctctgttgcccaggctggagtgcagtggcgcaatctcggctcactgcaaccaccgcctcctgcattcaagcaattctgctgcctcagcctcccaaatagctgggattacaggtgcccaccaccacacctggctaatttttgtatttttagtagagacagggtttcaccatgttggccaggctgaacttgaactcctaacctcaggtgaactgcccgccttggcctcccaaagtgctgggattataggcatgagccaccaccctgactcatacttcactattgaaacaaactttttttgtgtacagaagaaaaaaaattgtacagttaatagtgtcagagatagtgaaaatatgaaacaagaactgcttacaagaaaggagcactcaggggaccaaacctctgccagagccagcggggaagtgacttatgcctctctcttctttccctcctgtccccccccctcgtctcccgcaatgaagcgggtacttaatctgtgtcctgtggaggtcccctttggcagccagctggaagcccgtgcaccctccttcaaataatggctttcaatgagcagactagaacgtttaggattgcaaaggaaaccgattcctttcaaacctggttatctttgtgatgtggcactgtgtgcatatcttcgttaaaatgcattgaaggccactgcactccaccctgggcgacaagaggtgactgtgtctcaaaaaaaccaaaaacactcccccctcaccccaaagcattagacatcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcatatggaccttggacatctatcttcctgaacttttctctcctgtttttacattcttattttggtttgtgggaaatattcttgatattatcttcaacttaatttttgttcttgcttctactattttagtttaatttccaagtattttgatattgaactttcaagagaacagacatccctgccagccttgacgtctaatgctttggggtgaggggggagtgtttttggttttttcgagacacagtcacctcctgtcgcccagggtggagtgcagtggccttcaatgcgttttaacgaagatatgcacacagtgccacatcacaaagataaccaagtttgaaaggaatcggtttcctttgtaatcctaaacgttctagtctgctcattgaaagccattatttgaagaagggtgcacgggcttccagctggccgccaaatgggacttccacaggacacagattaaatacccgcttcattgcgggagacgaggggcggggacaggagagaaagaagggacaggcataagtcacttcccccgccggctccgacagcgggttgctccactgaggggcgttgggtgaggcggaagagcagacggggatccagaaggcgttgtcggtgacatcacggaaagggcgatttctatgtagatgaggcagcgcaggggctgctgcttcgccacctgctgcttcgccacgaaagagttcccgtgccgtgggagcaagtctgggacctctggtcggaccggagagtcgcagctgtgtgttagggctaggatggctcctggatgcgcgtgacgcaagtgaccttgcgtgtaaagggtgaggcatatgaggctgcggcggggcggaggggcgtgagcttatacttatgtttatctggcagaagaaatgttatgatcacgaaggtggtttttccagagcaaggcttagcagttttactgtggatgtgctgacccctgtgatttccccgaatgtgggaatcttgattacataatttgtggcagtggggaactgtgtctgtgttttcccctgggttgttgtcgttttaaaagtggattttgtttgctgtggaagcatatacaaggcgttagtataaactaataaacaggtctttgttcccatctgtaacttactttcaaagtaaagattttgccaggtagtggttggttctcacgcttgtaatctcagtagtctgtgagatgcattgataactttatgttaataccgctcgagctctggaatttgatgtcagtgtggtcaaataaggtggacccgtctctactaatctcttaacttttttttttgttctatagaaataaaactaagcttttcttttccctacgggagcccattgtaaacatttattaacagcaaacagtccactggagtgcatggcgggatcccggcttactgcaacctctgcctcctgccttcaagctattctcctgcctcagccagagaatactcgatctcctaagtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaaatgtcttttttttttttttttcccagtgtggcccaaggaacccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtaacaaaacccagctgggatcctgcaacttctaaccttaatgttagatcaagaagcaaaacacccaccagtccaagggtcagggaagatgaagatcatgcctgagctgtaacaacgcccttcccagtatacaaaagcgtgtaacagccacttgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttctcttttcctcctcttcctcatcctcttctttctcttcttcttcctcctttttcctccttgtaaagccatacttaaggttcaaataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaactattaatgaatatgatagcgaggatgatggaagatgagaattctcaagaaaagtattggttaatatataaccaaatgtattcatctcaaaataatgaagaaatactcctaactattacaagtcctcatttctgcaactgtcactggccctagctggtatttgtaactatcttcacatcttgctctcacagccatttcctttgggcctgggccagtggacgtgagcgtgggaaagaccagaacccgcggtgccccccaccgcactatcctcgggtctccagaggtgggatacaccgggcaggggcctttgctggattctaaaccggctctggggatacaagaacagctgcctttgagaaacagttcaagtctctatattccagacttcctagtaggactaaatgcttaatgttcacccaggaattcatggttctcctaaaaccctgcggtggaatgccttccttcaccgagcatttattgggcacctactaggtgctagggtggctctgggtgaagggctgcagcctgtgcaaactccaggtccctttcctgtggatcccacctctgagggcccgagggggacgcagtgaggacaccacgggttctggtccttcccacgcgcgcgtccgctggcccaggcctggcggaaatgactgtgagcgcaaggtgtgagcggggctaagaatgggaaagcgagtgactttcgccggagaagctgcagttgtcacctgtagaggggccggcgacttttgagacggtgaagagcaggcgggggaagcagtgaagagcagacggtgaggagcaggtggccctttggccgttggagtcccccagctgactctgcccgggtagaacgtccaaagtgcccaaagactcgactcttggcttcattgtctcccgtattctgggtttctggagtgcgcgggattggacaggcatcaaatatatgagattatctgcagccagaggttaaaaagccatttctggtatcagcaaatgagtttaagacacaagccattagagtctctgtggcgcaatcggttagcgcgtttgactgttaactgaaaggttggtggtgcaagcccatccagggatggcaccttttgcttaggcaagattcacagtttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacgccagagccactgcacctatttcatcacctcctgaagctgggtttttacaattgcacattcctggaaatccaaaactcccaataattgaaaacaagaaaaccccagtcttcacttgtagtgaagcctcaatttctgggttgaaatcttggttcattcatgacgtgacttttaaaacgttactggattttctgtacctcaatttcttcgtctataaaaaagagcagccgggcacggtggctcacgcctgtaatcccagcactttgagaggcccaggcaggtggatcacctgaggtcaggagttcgagaccagcctggccagcgtggtgaaactccgtctttaataaaaatataaaaattattcaggcatggtggcgggcgcctgtactcccagctacttgggaagctgaggcaggagaatcacttgaacccgggaggcagaggttgcagtgagccgagatcacgccattgcactccagcctgggcaaaagaacgagactccttctcaaaaaataaaaataaataaaaaataaaaaagaaagaaagaaagaaatttttcctggcacatttctatatgttccattctggatgacttgctcttcaggcttatcccacagctgttatcataatatctctctttactacaccatcttgggatttccatcacctctctcttgttagatcccctgcttcatggatctcaagggggttcattcctcactcacttcttccttttgatgatgcatatcctccaaaacctcctataaagtggttaccttagaaataaactttttgagacactgcatgtctgaaaatgtcttttatacccataaaattaattgatattttactagatagagatacaaaaagataggtggaaataatttctctctgagatttttgaaggcactgctttttttgtgtgtgacagagtctcacctcgctctgtcgcccaggctggagtgcggtggtgggatcttggctcactgcaatctccacctcccaggttcaagcgattctcctgcctcagcctccccagtagctgggactacaggtgcctgccaccatgtctggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccagtacatgcagcccccagtcacataccccttgcttgctcagttgatcatgaccactccaacacagcccctttagagttgtgggcccttaaaagggacaagaattacttatttggggagctcagtttctaggatgtgagtctaccgatggtcccagctgaaaaaagctcttacattccacaatcgggtgtctgagggattttgtctatgactcctgctacagtttcaaactcctgacctcaagtgatccgcctcccttggctttgcaaagtgctgggattacaggcctgagccatggctcccggcccttgttgtttactgttttccatagtcatttctgagaaagaaaaaggtaagccttttctgctctgagctagagctggtctgacaaacacctaggccatggtgttctatggttaaaatgaaaaatttcacaacaccaatatcagacaaagttaccctctcactaaactgaaagaaatactatttcacaatcatatttgagcataaaaagaacactgttcaaaccataatatgatcaaacatcccagctactaatagtgacagttaatgattttattttttatttttttgtgatggagtcttgctctgtcaccaggcttgagtgcagtggcacaatctcagctcactgcaacctctgcctcctgggttcaagcaattctcctgcctcaaccttccgagtagctgagactacaggcacctgccaccacacccagctaatttttgtatttttagtagagactgggtttcaccgtattggccaggctggtctggaactcctgaccttgtgatccacccccgccccgctcagcttcccaaagtgttgggattataggcgtgagccactgcaccaggccagttttttttttgttttttttttttgagacagtctctgttgcccaggctggagtgcagggacgtcatctcagctcactgcaacctccacctcctgcgttcaagtgattctcttccctcagcctctcaagtagctgggattacaggcatgcccaaccatacttggctaacttttgtattgactgttgattctttaccaattatgtgtttagtcttgcaaccacttctcccactttctagataaaaataccgagattcccaaaggaagaattgccccacaatttccccatagtgtttgctgtctcctgtgttgcaatgagccaatatactcaggtttgactataggtttgttcctgatgattatacactggagcacatcagcaccatagagaagatggatgccgttctgattctttgttatttgccttaaactcttctcccatctcccctcccaaaagcctatagaatcttctacctcttcctattagtttgaaacttcatgatctatttccatccaccatgctgggtactgagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaataacaataattggctgggcgtggtggctcacacctgtaatcccagcactttgggaggccaaggcgggcaggtcacgaggtcaggagattgagacgatcctggctaacacggtgaaaccccgtctctactaaaaatacaaaaattagccaggcgtggtggcaggcgcctgtagtcccagctactagggaggctgaggcaggagaatggcatgaacccgggaggccgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctggttcatttggggctggatggtctaggatggcctcacacatctggggtataggtggattggttggaaaaagtgggatgcatggatctttttcttcatgtgatctctctagcaagctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatagccaatccaagattcaaagagaggagaaatagactctcttgatgagagaagctgcaaaatataaccactttttttttcaatctgtcacagtataccatactggactatcagtagcttcctcatttttctttctttctttctttctttttttctttctgagacggagtcttgctctgtcgcccaggctggagtgcagtggcgacatctcggctcactacaagctctgcttcccgggtttagccattgtcctgcctcagcctccctagtagctgggactacaggcacccgccaccacgcccggctaattttttgtatttttagtagagacggggtttcaccgtgttagccaggatgatctggatctcctgacctcatgatctgcctgcctcggcctcccaaagtgctgggattacaggcgtgagccaccgcgcccggccatgacacaagtttaaaagaatatttttgtttgtttgtttcagacgagtctcgctcttttgccaggctggagtacagtggcgtcatctcggctcactgcagcctccgcctcccggattccagcgattctcctgcctcagcctcctgagtagctgggattacatgcgcccgccaccacgcccggctaatttttgtatttttagtagagaaggggtttcaccaagttgtccaggatggtctctatctcttgacctcgtgatccgccctcctgggcctcccaaagtgccggcattacaggcgtgagccaccacgcccggctaaaagaataatttttattttattgtttattttattttatttattttattttatttttattttattttattttattttttattttattttattttatttattttattttttgagacagagttttgctcttttgcccgggctgaactgcaatggtgcaatctctgctcactgcaacctccaccttctggtttcaagtgattctcctgcctcagcatcccgagtagctgggattacaggcaccagacaccatgcccgggtaatttttgtatttttagtagagatggggtttcaccatgttggccaggctagtctcaaactcctgacctcgtgatcagcccacctcggcctcccaaagtgctgggattacaggcatgagccacctcgactggcctaaaagaataattttaaaaaatctttttttgatcaggcttggtggctcaaacctgtaatcccaggactttgggaggccaaagtgggtggatcacctgaggtcaggagtttgagaccagcctggccaatatggtaaaaccccatctctacttaaaatacaaaaaaattagccggggttggtggtgtgcgcatgtggtcccaactacttgggaggctgaagtgggagaatcacttgaacccgggaggagaaggttgtaggtagccgagattgtgccactgcactccagactgggcaacagagacagactctgtctcaaaacaaaacaaaacaaaacaaacaaaaaaacaaaaaacagcaagcaaggaccccatggcctgcaagatccaaaccagtaaaggagcagctcctcagagacaggcatgtgcattagagagaaaaagtatgcttaacatgacttcatatgataatcagctcattaaaactcatgcatatggactacatatcatgcatgtacttaaaattatgggatggaggcaacgtgcaagcacacaagggccaaagtagctaagcacctgtcaatcaaaagacaaacactggctaaagattaggcatccctgtgaagagaagaaaaaaacacacataaaaagacccaaagtacaccaaactaatactgatctcatctcccagactctccccactctgagagtgttactgtgcttaataaacttttgctttgctttgctgctttatgtgtgtcatgtacagttctttgtttgggacaccaaaagcctggaacttcatggaaccatctggtaagaattaggattttttttcctaagggttaacaaaccggccctttggaaagacttgcctctccactgttatcaaccaatggcctgaaactttccctcccttttgtggttttgacaaaacaagcaagcagcattccctcctgataagagaccactgacctaggaatgattctggccagactacagaggatgtacagtgagggttttcatgtcctctgcttcagcttttgatgtcagagggccacaaactcctccactctcagatgattgctaatgccaccattttatgaacatgggccccatggagaggcacgaagctcaattgcacttctgcacatttttcctcctataaatattgctattggaatattatttggtactgctcccgtgaaagatacatttgcggaatgtactcaaattagaagcatcatgtaaaccctataatgtagcaatagtgcatcaacttccctacactatagaaatatctgcggtgtagacatttccacaatgaccaaagatatgtgtacaagaaaggtggctgcagcattctttgtaatcctaaaacaatgaaacctacctcatctcaaaaactttatttttttatttttattttttttgagatggagtctcgctctgttgcccaggcgggagtgtagcggtgcagcctccactggtgcagcctccactgcagcctccacctcccaggttcaaatgattctcctgcctcagaatcccaagtacctgagattacaggcacatgccaccatgcctggctaacaaaaacattttgaaaagggttaaataaataatgcacaaactgaggaaaaatactgttttcaaaaatgatggagaggatcactatgatgatgaatgattccactggtcacattattgatagaccaatcagtaaatccaggcacatcctggagatactactggactcctattactaaaatatgaaaaaacggagacaagtaagttactcatttaagcgtataatcgactgaattagaattttatcacaccagaagtgggttcctaggtctctgtttcaggattcctgagttacacaggtgtaaacccgccgtttcaggagatacccgattaagaatctggtcggggagctggctggcccttgacatggatcagtcataaattagtggctaattcttccccatttatgtagtgattgacaatacgtgcatgctttaaaagttccaataagcatccctgggtgggctcgaaccaccaagctttcggttaacagcggaacgcgctaaccgattgcaccacagagacaagcactgctaactccactgggccatataggaagggcgcactcactaaacttcctctgtcccttctattcccagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggagtagatcatcatgaccctctgtgttccttttggcaaatgacttgcttccattgtttgtttgttcaattgtctgtttgttaaataaataaaaccctttttatgtatctttaaaattacattggttctattattttatgattacaaacgatgctgcagtcatcattcttgtacacttctcattggccactggtgtatttctatagggtggaggcctggagagcagttgttccagcatagtgtttacatagcttttatttaattccgttttctttcctttgttgctttattagctataacccttctcttatttcagtggcagctttagggtttctgggatacatctttaatttatcacattctgctttcaagtgtaattatacctccctttctggcctttatcctagtgttacgtatttttactttatgcattataagttttgtgattatcattaccttcatttattatgtcaaatatttttaaaaagatttaaattataagaaaatgtgtagtacatgctttctaaatgccatttccaatatttgtttttgtataggtccagatttttatctgggatccttttgcttctgcctggaggactcttaagatttcttgtagcgtgggttggtgaattcttttagtttttgtatgtttttcaatgtccttatttcactcacagttttgaaattttatttttgcatagaattctaggttaatttttttctctagtactttaaaaatgttgccatttatgaagcattgccatttaaagtatcatctttcatgtgcttgtgaaaatggcataaagccggtttcttgtgctggttatgtaattttcagaatgtgtatttaaatttaaaatattaaattttcctaaaaaactaaaaatattaatcatgaatgtcctagattcatcttaaattccaccaacagtgcacttaaaatgtgcccaacctgagggtcaaacctacctgctgacatgtaatttgtgtttgtgagacattctcaacagcatttgctttccccagctgagtgatcttcctcacatctgaatgtcttcagtgcaaaaggaaatgtttttcttcgcaaaaatactttcaaatactcttacttcaaggaagtgcattaaaaacaaacttctcatttgcatccctggaattcaaagccctaatcaagtgcttcaggatcaagagctaaacaggggaggacaaagcgtggcttcttcactaggagtcaagccaaagtcaactggtttgatcgccaacgtagatcggaactcggttcaccagcgacctgaggacccggcccagaagagggagtgtctcttcatggtgccttcagatagaaaatctcctaggatttctttctttccctttgatctacttccaactctccctttctatttcttcaagacctttttcggatccctactgcgaaggacctaaggggccggtgcccttccccactggtccctccctgcctggtgtcttaggagcccaagctcacctggaacattactgcccgccggagacagcgagaggaccaaggagcgcggcggtgcggtgggaaccacagcgtcaccgctcacctgcgcctcgtgggctcctagaaaattgaataaatgccccctgaagcttctctgcaggtcacacggaagaggagggtggctgccgacacgcgggagaagcttcaagaagcgtcgggaggacctacctggtcctgcccctgggccttgaagacaggcctggccaggctgatttggtccggtagtctcaaagaaaatgttcaagggtggcccaaacctccaccccaagattaaggctcttaaatgtctgacggttttgagactcgtcagtagaatcaatcccgcctgtatcaggagactcctttgccaaaattcaaagaccaagaaagagaaagattgggcaggttaaagtctgtaattaaccaaacaggagacagaatttttctgagaaattgtatgtgtgctgtgagaaaaagactagcctcaaggagaatctgttcttttggcttaattgtaggaaagaatggaattgccaccaacaatggtacgttgaaacggcaggtgcatcaggctgtagatgtgaaggaattaaaaatattttaccccaaaatacatttctttgacatattttgagatgtctgttcagaaagccagctgcagaagtagccctgcaaagttgtctttcgttggggagatttgcatctgtagggaatctgcattgatgcagccaagtctttccttgcccagatctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactctaatggtacctggttttggccatgctttgagcctttattcattctgttaacttgagacggtatataagcctctgcatcccattgtgtgtttcactcacgtccatgtgaagagaccaccaaacaggctttgtttgagcaacaaggctgtttatttcacctgggtgcaggcgggctgagtctgaaaagagtcagggaagggaaataggggtggggccattttataggatttaggtagataaaggaaaattacagtcaaagggggctcttctatggcgggcagggatgggttcacaaggtgctcagtgggggagctttctgagccaggatgagccaggagaaggaatttcacaaggcaatgtcatcagttaaggcaaggaccagccattttcacttcttttgttgtggaatgtcatcagaacaggccatttaaatttcacttcttttgtgattcttcagttatttcaggccatcttgatgtctacttgcaggtcacaggggatataatggcttagcttggtctcagaggcttgacattcctgtcttcttatattaataagaaaaataaaacaaaatagtgttgaagtgttggggcgatgaaaatttttggggatggtatggagtgataatggacgatgtttctcagggccactttgagcgggattaggggaggtgtgggaacctagagcgggagaggttaagctgaaggaagattttgtggtaaggggtgatattgtggggttgttagaaggagtatttgtcatatagaattattggtgatggcctggatacggttttgtatgaattgaaaaaagaacggaataagacaaggagaaaaacaggtattaaaggactaagaattgggaggacccaggacatccaattagagagtgcccaagggggttcagcatagccctgccatcaaagattatttatttactttaagagggagttaagagtggcaaatctggggacagcaccaggagatataagctgtgatggcttggagaaacagagtaaaccgccagtttaaacaagagcagagcatttatgagtagttgagaacggtgaatagaagtatgactagacagaagatagtagtgatgacaagtttttgggggcacagtccaagttggtctggtgtctggaatgagactggggcctaataaaaaggaacatctatacaggagcttaaatgggctgtaccctgtagcattctgaggacaggcccgaattctgagaaggcaagtggtaaaagtattgtccagtcctttttaagttggtggctgagcttggtgaggtgtgtttttaaaagaccattagtccgttttacctttcctaaagattgaggaccgtaagggatatgaaggtttcactgaataccaagagcctgagaaactgctcgggtgatttgactaataaaggccggtccgctatcgcactgtatagaggtgggaaggctaaactgatgaatgatgtctgacaaaagggaagaaatgaccgtggtggccttctctgaccctgtgggaaaagcctttacccatccagtgaaagtgtctacccagaccaagaggtattttagtttcctgtctcgaggcatatgagtaaagtcaatttgccagtcctgggcgggggcaaatcccctagcttgatgtgtaggaaagggaggggcctgagcaatccctgaggggtagtagaatagcagatggaacactgagaagtgtttccttgaggatagatttccacgatggaaaggaaatgagaggttctaagaaacgggctagcagcttgtaacttactgtaggaacacaagatgactgctttgggggtagtgttgggtagctgctattgtgctaagggctgaaattgactgaaattacctacaatttaccaactgggccttcctccagaagttgcaagccatcagtaggctccagagctctgaaatatttacatcagacagatcctgcctgtgcagttgttgtctagattccaggtgcttctcattccaccatcttcccaggatacactctgagcttctggattttgaattcagtcaagctgttctgtaacagctggggtgaaagccagcaatgatcctgctaagaaagctccctggaaaaaaaaagttcaaaagtaacataaatatcaaactggaaagaaattgatttaggaaccaaacccaggttgtcatggtgaaaaaaggggcagaaccttagctactgaactgcagcctggggtacgaggtgacaaccattgcttttttagtttggtttggctagcaaaggtggccttgttatataaataaagcccctctggtagtcaaaacctttattttctctctctctcttttttttttttttttttttttttgagaaggagtcttgctctgctgtccaggctggaatgcagtggtgtgatcagggctcactgcaagctccacctcctgggttcacaccattcttctgcctcagcctcctgagtaaatgggactacaggtgccagccaccatgcccagctaatttttttgtatttttagtacagatgtatttttagtagagtttcactgtgtttgtcaagatggtctcaatttcgtgacatcatgatccgcctgccttggcctcccaaagtgctgggattacaggcgtgagccaccgtgcccaatgaaaacctttattttcgtgatggctgcttatttatttatttatttatttatttatttatttatttatttattaatttttctttccctgctctccctctttttaaatttttattatttatttatttatttttctgcagagatttatccaattcagaggtcttgtccccataatttggaacattcctttggatttgatcaagtcagatagaactggtcaaacccaatggggaaaagaaggaaacaacaataaaaacaaacagaaaacaaaaaacagttcagaaaattaatgatcgcacaatttatatgattgcttagcactctaacggtaagaagaaattatgatcagttggttgttaatcttttttatttttttattttttattttttttgagacagagtctcgctctgtcgcccaggctggagtgcagtggcgcgatctcggctcactgcaagctccacctcccgggttcacgccattctcttgcctcagactggttgttaatcataactttaatcatttaggagaatttcaagacaaaacacaggttcagttacttacctaggaatagggcccaggctgaagactgctctgtaccatcctagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaaccttagatctcgatcaaattttgggaaatcagggattctctggagggggtggatctctgaggcctcagcaaattttcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaagtatagcagccaggtgcaaattgtgggggcctggaaataattttggtataacacagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccactcgctgtttagccctgatttgcatatgagactttgtgctagtcatctggtaacttttcactcagcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactttgaggtgggtgaagattagagcctggattaatcaagggcctgtggcttctaacaccatcagttgcctgtactcagccaccttcagcagtgctatctggctctagagagccatagcattccaggaaaggaaagaagtctgcacaaagccctgatgtttgtgtccccccatctagacagacatagtagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcatcaatgaagagtttcttcctcattgaatcactaacacgttttggatctctctgacttcctagtttgctgacctctgacctctagatccagactttaaaggcccatgttattagattagtcaacctttataatctccccattttaaggttaattgtatctgcaaaatccctttgccatacaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgtattatctgagttcctttctcaggaaaccaagcgttgggccctccagatagtatcaaagaactgaaatttaccagagtaccacatctggacaatgaaatgtcagaccccttatcccatcaaaattgcctaagtgaccacctgcttcctgttgaccaattcctctttcttacctctccctaattcctgttttcctgtatgtagttccatttcttccctgctatctaaaccctgaattttcattggtcaggaagatggatttgagactgatctcccatctcctaagttgtagtacctgatgaaagccttctttcctagcaaagctagttgactcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagagtacaattataaatacacatgcatctaatagagcctcaaaacacaggaagcaaaaagtgacagaattgaagggagaaatagacaatttaacaatagtagatggagactttaataccacaactttcaatagtggatacagcaactacacagaagatcaataaagaaataaaagatttaaacaacataacctaccagacatctatagaatactccactcaacaaaaacagaatacacttcctctcaagtacacacaggatgttctatagaatagaccatatgctagcctttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccacagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctataattccaatgttttgggaggccaaagtgtgagaataacttgggcccaggagtttgagacccacctgggcaacatagtgagaccccatctacacaaacacacacacaaaaaaacacacacacacacacaatagctgagtgtgatgacatgtgcctacagtcccggctattcaggaggctgaggcaggaggatcacttaagcctcggagtttgaggctgcagtgagctgtgatcatgtcattgcactccaggttgagcagcagagctagaccctttctattaaaaaaaagcaaaaaaaaaaccaaaaaactaacatgcttccccagtgggggaaatatgtcagtataacattggtttgcagcaagaagtatattaagatattgaccaaaatccttttattatttattttgtttttattttttgagacagggtctcactttgtcatccagaatggagtgccgtggcatgatcttggttcactacagcaaaaaacacctggacccaagcttgcagtgagcaatcatgtctcactgcaagctctgcctcctgggttcacaccattatcctgcctcagcctcccaagtagctgagactacaggcacctgccaccacacccggctaatgttttgtatttttagtagagacgaggtttcaccgtgttagccaggatggtctcgatctcctgacctcatgatctgcctgccttagcctcccaaagtgctgggattacaggcatgagccaccgtgcctagccccatgcctggctaattttttaaatttttttgtagaggcagggtttcgtcgtgctgcccaggttggtctcaaactcctgagctcaagtgatccaacaaccctggtctcccaaagtggtgggattacaggtgtgaaccactgcacctggcctctaaatcgatataagtcaattattcacacactgagaggaatattcaggatttttttcttataatataaatgatgtggaaatctggagaaccaaagaagaacaccaagactatctaaaagtgttaaatttttcattaggaagaaaatgaattcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgctgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttagatacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacatactataaaatttacccattataattgtacagttgaataatttttagtaatttacccaagtagtgcaaccattaccataatccatgcatttgtttttaatttattatttgtctgggttctgattctacttccaccacaagcttcagcatggcagtatctgccaccacttgttttggtccaagggcagaaatgagcatcctggaaaccaatcagtacttgcgctctgaactggaaaagtgcaaacagaacttccaagacctcacagagaaattcctgacatccaaagctactgcctactgcctggccaatcacctgcagaaatgtagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggtgagtgtagtgaggaatagagactaaaaccttggtttaggcatgaaactgtctttcccctctcagcaatgaatatcagattccacaaacatgtaacatcactgttggttaaaacatctcaggattcgatttaaacttttttaagagcgcccatttgcaaagcactgtgccaacagcatcaggggtgatagaagtaatagtataccctatctgccttgaaggaacttaaaactagctattctcaactgagtcacagatatgtggagatgtgaacttcaatagcagacatggaaaaaagtctttatgatacctggatcaagattctcttcccacaaaagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacctgttactaatagtcagggaagggaagctgtaatgacaaggaaacatgggaacaagggcatgagaggaacagggatattagaagaggattctggttaacatagaaattgagtttgttttccaatttctacaattattttaaaatacatcattgtgtggggggtggctaaaagttgctgtctaacttactgtcatagaaaagtaaaaccaaaagcccacttattaaagaagtgaaaagatgagctttggtgtgtggaaaaactagtttaaaaaaaaaaccttcactcattataattgtaggaaaaaaatttctcaagctagagaagaagaaagatattacctaagaccctagtataaaggtattattgtgcagtgattaaaaagcatataccctggggccaaatttcctgggttcaaatctaacttatcatcactgtgcctcagttttctcatctgtaatggtaatagagtaggaactacctctttggatggtggtgatgatcatatgatgataattcttaaaaacctactgcaacagtaccatgacaaacactatgtgttggttctccctttaaaacaccacctattagcttttgggcacatatcatttggatctttctcctctatatacagttttacacagctgtatacagataaatgtttaaatctttgaaatattttgggattattgaaactcctgacacaggaggaccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtatggtggggcacacttgtaatctcagctacttgggaggctgaggcaggagaataacccgggagtcagaggtgcagtgagccgagattgtgccactgccctccagcctgggcaaaaaagtgagattccatctcaaaaaaaaaaaaaaaaagaaaagaaaaacatgtggcgtcagacctcaggggatgtgaattctgactgcctcattccagctgaatcatcttgtcaagtgactttatcaggcttttctttcctcatctctaaaacagggagtagttgagagactgaggaatacagatatggaaatcccagcgtaaagcctcgtactggggatacttttatccttgagatagaccctgcctcctgccctgcaggcagtgaccacagcagcatggccagccttccatgatgcaggcatgtctatcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagtagggcagctcaggctggtagaacaaagagcaaatttgtgcaaggagaagggcagaaatgtatgactcaggcacagaactagactaagacacaatgaggttatggtctagttaggtctctagggttttccattaaatagcatattagtaaaatggagacagctgtctgcattggaatactagcaatgtggcttctatttgtgtgtccttggtcaaatttacttcacttttctgcgtgtcattaaactaggctacctcatttataaaatgcaaatactgacagtatctacttagagggttatgaagattaaatgcacaattgcaagtagttagaaccatctctaacacatataaaactctgaacaactattttctgtaattattatatttgtccccatttatagatgtggtgattgtcattaatattttctataagagatattttcaaactttccaaagtgcctttcatgataacaatgtttctcctccaaactttttaaaaaagtattatactaggtggagtattaactggtagggctgttgggtagatagatgattgagcagctgttgtgtggaaaatgaattattaattcgctcaggaccagcattgactatccttagagggtttcagacataaggtagattgtcgcattcgaaacttcttttaatcctttgttgaaatgaaatcatagaagctcaaatttgtaaaactcaccaaagcagagatatttgattgaaggtgggataggtctggagcccctgtttctccccagtatgtgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgggtacatactaccgggtgctgtaagttgggtaataggtagcactatctttagactcacagagctcacactctacattggaacccatgtgtattagtccactctgacactgctataaacatatatctgagattggtgatttataaagaaaagaggtttaattggctcatggttctgtgggctgtacaggcttctgcttctgggcaggcctcagaaaacttacaatcattgcagaagtcaaaggggaagaaggcatggtcttcacatggccagagcaggagagagagagagagcaaagagggaggtgcacactttcaaacgaccagacctcatgagaactcactcactatcatgagaacagcaagggggaaatccaccaccatgatccagtcactatccagcaggtccctggttggattacaatccgacatgagatttgagtggggacacagagccaaaccatatcaccatgagaaatatttaaacaataattagaaaaaaaataaatccgcacagagtaatgaaattactactcagaactttactttttttctttttttgagatggagtcttaccctgttgcccaggctagagtgcagtggtgtgatctcagctcactgcaacctcaacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcatgagccactgtgcccggccagaactttagttttaactgccttcttactgattatagtctatcttcatgtcattcagaagaatactgcccctcttgaccttttcactgatttttctttttaactttcaattaatactagagataccggcccaacagttttgaacttggcttttttttttttttttctgccagttactgcatatgaaaaggtacatgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacactgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggagtcagaggcggaggttgcagtgaaccgagatcacatcactgcactccagcttgggcaacagagtgagaccctgtctcaaaaaaaaagaaaaaaagaattcaacttgggagttccttacagggattctaagagatctctcctctgaaacttctataacctattattcactacattccctcatacattttactcttctttcccaccttaggatacatgatcccttaattcaggctcaggctgaagaactgacccacttacaacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgccccaaagtggggagaaaaaatgcaaacttatctccattatagattttattttagttttgactatggtccttaatctgcattctattgttttctctttagagcactcaggtaatcacttttcatattctttctagaattctaagttttgttttttattttgagacagagtcttgctctcttacccaagctggagtgcagtgacatgatcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggctggtcttgaactactgagctgaagtaatccacctgctttggcctcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccactgtcttctggcttacactgttccaacaagaagtctgccataattcttatttctgtttctctgtacataatatgtcttttttctctggatgcttttgagattttctatttatcactcgtttgaagcagtttgattaagataagaccttgtatagttttctcttttacatattgttctactttatttagtttcttgcatctgcatgcttatagttctcatcaaatttgaataataatgacatacatagtcttacctatggcatatacaatatattatatttggcatatatacatcaaatatatataatgtatattctattctttctctctatcttctccttcaaagactccagttatatttatattagctgctttgaaattttaccacagctgactaatggtctgttcatttttgttgtatcttttctttctctctgtttctttctatttccatgtcttggaattgattaatctttcttcagcagcatctaatctgctgttaatcctatccagtgtattttcatctcagactttatttttcatctaaatttaatttatgtctttttttaagttcttctatgtaactcttcatcatttcatattttcctctagcttctttattttattttattctattttttgagacagagtctcgctctgttgcccaggctgaagtgcagtggtgagattttggctcactgcaacattcacctcctaagttcaagtgattcctgtgcctcagcctcctgagtagctggaattaccggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcctttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctctccaagctggctttttaatttttttcaggcagcataagagcagctattagtcaactgctattttttttcccactatggaggcaaaatgacctttaagaaaatagaccttattttttagagtagtttcagattcacagcaaaattgagcaggaagtacagaaagttcccatataccccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcacgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccgatgctaatctaatgccatcgttgatctgacaggaggctgagctcaggcggtaatgctttctcgctggctgctcacctcctgctgtgcggtcccattcctaacaggccatggaccagtgctgggggttggggactcctgttctaaccaatgctccctctattaaaagggattttcacactagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgtcttcttcaaagttactaccaggctctgcctgggtcctccctccctgctctacagttgacaatctcaggcagcaaactggagcaatcatagggctcacctcttttatttattatagtactgcactgtatccaatgttgaagatagagtttaaaatactttttccagtttctcagttgtttaaggtggaggacaaatcaggtccccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccaaggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaagaattacccccaacaacatctgaggaagcacaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcagccaggcaagtattctttgagctggggaacaaaaggcatttaaaactttttgctctgcttcaggcagctgacgtctggtgatgattcaccatatcaggaacaccctgtccagtgggctaaggcaagcctgccaggccacttctctaaagacacaacctgaggcctcctgcaataattctcacagagcattctgaacatacatgtaagctgttatgtccctgatcatatagggcccatgtgtgcaatgtgtgaaatgggacctgcttaatttctgactagctctttctaattttggtttgcagaaaatcacaatggtaagaaaaatgaagacaggcaaaagccactggctcccaggtaactctacatgatgaaggggctgataatggactgaccaaatctagagagaattccagaagcaaggactcaagaggttgaaggtcccagatctagaaaaggcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccgtgggaggttgtgttgtctcaagagccagtattcagtggaccactccacatcatatcaaataaaatttaaacacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccttggtttaatcccttgtcttgcctacttcacctggctcaagagggaagtccaggaggaagaaatggatgaagtcctggagtactcactagatgaacagtatttgactcattccagctgccatgactcccaccagcttcccagcagcaatgccttcctctttgatgcacaggaaggcccctcggctgtggaaacagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagaccggcatctgcaagccggtatactcaaagcaggccagaatggagagagtgaagagattatggcagactctctgccactactgccgcgcatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccaggttcaaatgaccctcccacctcagcctcctgagtagctgagaacacagatgcatgccactactcctggctattttttttgcctttttggtagagatgggttcttgcttttttgcccaggctggcctcaaactcctgagctcaagcaattcacccacccctgcctcccaaagtgctgggattacagatgtgagccaccgcacccagccttcctgaaatactcttgataattatagttcctgaacagctttcccaagctgttctagccatcccaagaatgttggcaggcttgtccatatgtttggaggtgcaattataatggttcctgggtttcaagctccagtctccatctcccctcagatgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttcgtctcagtgttgtaattccatctaaataaacaatgaggctatctgctggagaaaaggctgaatctaagagcaatgccgccagcatgccctcttcccagaataactccacgctagccattggagcttcattaggtatataagagccctttggtttggtagcctctctggtgtgtgtatagattaaaaccttgacctatatctcctctcccttacttgaatgtttgactttactttgggggcaaaagtttggattgttaggagactatatgctttatatactcttctatgcaataaaaagagattatattaattcactcattgagctttcacagtaatataaaccatattaggcttgtcattctgtcagtgatgggtgtaagtttgtggctttaattagtcataccatcttctgacaaaggcatccttatttctctttccaatttcacagtaatggtgcagaagaaggtctttaccatctgttaaagatgttcagggccgggcatggtggcccacacctataatcccagccctttgggaggcctaggtgggtggatcacttgaggtcaggagttcaagaccagcccggccaacatgctgaaaccctgtctctactaaaaatgcaaaaattagccaagcatagtggtgcacgcctgtagtctcagtcacttgggaggctgaggcatgagaatcctttgaacctgggagatggaggttgcactgagccaagatggtgcctctgcactccagcttgggtgacagaatgagactctgtcaaaaaacaacaacaaaaacaaaatatgttcaggagagatattttgtagagaggaagatattccctagtacctataagtcatctcaaggaagtggtcataccttttctagtgctagaaaagccctactcagagaccttcagtgttttcccacctcctgtcaacctgccttatacttcccatatctccatgtgggaggcatccctgtggagtttgcttagcacttggccatgctttctttgaaaccttaaaagctcttaaagaaagttgccttatgttccctgatgagaagatgaagttggcaaaagaatggtgaaaggcagggatcttgacgagaggcccctgactatccctttagtgatcagcatcttcacttcccatctcattccatgtcctggtggaatggctgcagaagatgagatccagagccagtggcagcacctgaaggagacccttttcatcaacaactgcctgtgagaaaagctagaacgtcatcacagcagctttgatgaagaaaatggtaggagaggcccaagtcagcctgcttctggcaatatgtatttttctaaaggcgtgtgactggggcagagttttatagatttcaaacactttgacatactttacttcacttattcattacaaatgtcccagctagagaggcagggcagctactatcattcctatttataggtaaataaataggcttaaagatatgccttcatcttagaggtatctacttctaaaatcattcttgtgattcctaagctgtctgctgtcttctgtctgctgctgtacactgcctgctgtctctctgcttcttatgtgattggcattcagtagaacccaggtttctgagcacctcacataacagaatgagtctcctctgctgccatcctcatcatcttcccttatgtcttggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaagaaatacagtatttcggtgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctgagtgacagagcatgattccatctcaaaaaaaaaaagaaaaaaaaaaaagaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccgtgagccaaaaaagagcaaaagtcctaattttcaaactgatgaaaataaagtactaaataattgaaatcgtcgtagttcatcttggtccttggcaaaataaaaatttattgattgaaattataatatactagctaccttatcgtgcctagctcttaccactgaggagaaaaaccaaacgcaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggtagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccagttgagaaagatagtgatttacttcggactgtgaaaagagagactaaaatctttactttctcatgggaaagaagcctatggtgaaagagaaacaaagaaaatggtgggaaatagggtaggtctactcagtagctttaaaccattctgtcatattataaagcctagtaaggttttaactaacacaagtgcctggactctacacatagagattctgatttaaatgcttccaggtgggtggaagacactagtagtcttaaaaagctcccaagtaattttaacatgtagctaaagatgaaaaggacaatctatctactagaatgtcaagtcgccagcataggagtgtcccaaatgtgcagctacctcatagaaaaggcttaaccccacccattgatggaatttgccttcctctctccatggtcttgtttgcatagcatggaaaaaaagagaagagaaaaagaggtagatggatagattgaacctataatttgcctatgtggagcagtttctcaaacttttctgaccacaagatgcagtgagaaatacacaattctttgtgatcagtttttaaaaaatcttttattatgtgtaatccacccttcctagtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttttttaaattagctgtgcgtggtggtacctgcctgtaatcacagctacttgggaggatgaggcaggagaattgcttgaaccctgggggtggaggttgtggtgagccaagattgtaccattgcactccagcctgggcaacaagagcaaaactgtctcaaaaaaaaaaaacaaagaaagaaagaaaaagacaaagaaagaaagtaagaaagaaagaaaattttttttcacttttgctcagcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcatcccgggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcccttcctgggaggtgtgaaagacctttatttctctccagaggagtattatggatgtggtagagacctggctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttgcacctggcctgtatcaccacttagctctcactctagcctcagttaggtatcagcaagacctcaccaaagattattgtttcgttgtatgtgcgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgaaaagcaaattttatagccactccagatttgtattccaaatggacagtttgattgtagaaatcacatcccttcagtctgcaaatgtgataactgcccaagagacagtgatgcctagatccataaataatcccctttcccccaacctatatataactggagtcaacagcagctagaggaaaatggcaaggacttggaatcaagattaagttagaataacactgctgtagactgtttatcagctcttcagcatatgtccactttccttgaaggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgacgcagggcaggcgagcctcaaaactggtttgtagcctgagaaatgtctcccagactgtagtttccttggctttgccaagcaaagaattcaagggcaagccgctggtgaaagcaagcaacttttattgaactggtgctgctacttgcagagcagggctaacccataggcaatgtgcccagagttggtgcctgtgggctgctagctagttgtatttagacccacttttaattacatgccaattaagaggtaggttattcagaacttcctggaaaaggggcagggagtttccagaaccatataaagtaacttccaggccattgccaaggtgtgttgccatgacatttgtaaactggccatggtcccagtggtagtgtctttatgctcataagcagtgagagcaactagaggtcactttcatcatcatctgctggtttcagcaggcttcttcactgcaccctgttttgaccagatcctgctctgttcaatggtccttctggtctcctacctcatttccccatcagagattatatactcctccttaatcttaaggggcttgcagaagggtggaggttcatcttctgtaactgcttcctgctgatgttatgggcatagaccctgtctagcactggagaagtaaaatctctggatacctgttctaaaagacccaaaggcaggatgtctttattttctgggtcagaagaggggatggattgaaagccttgtgccagcatcgtctttacatggaattattgtaatctagaagacacaaactttacaaggaggttaaacaagaaaggaccaaagattagtaataacaagatatctgttaaaggtccgaggaagggtaaaaatcaagtgtctgctggtagagattcctttactgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcattttacaaggtcaggagttcaagaccagcttggccaacataatgaaacctcatctttactaaaaatacacacacacaaaaaaaaaattagccaagcatggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaggttacgtttcatttccatatcattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatggtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttacagtctattggatattatggtgaagggcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagatcgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttgaatcaacttcattcatcatggaagaatgttccattcataaacagattaaagagtaccttagatccatagaaggtgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgatcatgcgcttactctgagaaacacaatactgtttctgcatcataacaaagatctagttgtgcaaactgcacagccagaccaacccaattatggttttcctctggatctcttatgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttatgtttatcatatcactggacaaggaccaccatcccttttattatccaaaggtacaagacctcgaaaactgccagatatatttcagagttacgatcgattgctaataacatcttggggtcacgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccgctgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtgtgtatgtaacttttacagtttttcagctgaaagttgtatttttttttaatcagggctctttaatctcattttaatttcctttgtttgaatgaactgtagttattttttgtattcctatattaaccatctaaaccaactgtaatgacacgtacactaataaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatggggtcccctctggtttcttgtgttgaatgaggcaagagtaatcatctgattctgagctaaagacctctcatactctcaaggagggagagtgcatttttagagcttttagcaaaaatgtgaaaagttcatgtttgcactttgctttgtgaatttggcttccttttacttatacattaactcatgtaatgtcttaaatcttacaagtattgatccatttcaacaaaaaggtaaatttaaaatgcagactttgttacttgccaaagaagattcatgaaaaatttatatccaattattttccaaatagttaatttaatttggctttttaccacattccttcctttctttcccaacttctttaatgtaatttaaatcctggaaaacattttttagaaaccaagaggaaaagaagaacacataccaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcagaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcatatgcaaaagggctatgagtaggaggaaaactcaggcctctgaggtctcctgaaagagttttgctaatgtcacaactggctttctatgttatctgaagattgagatctccatgaagagtgaagataggtaatgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatacttgcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcatctagaggggtcttactggaagccttttactcagtccctttaatttccttgggtgtatactacggttccactgacatggatgacctggtagtagcgcagcagcctgaaataccagggtttccttagctgtggccttagctgctctttccaaaagggaatttcctctaataagaacagtgtcttccttctggtgtcccctgcagtgaatacttgttatttctttgggaattggacggcatctaaaagttccaagatctgagtaaagttgtatgggggatcccttggctcttgatagtcccctttccttccctatggttgcatgagcctgaagcacccggaaaccatacttagagtcagtaaacacattgactcttgagggtttttttttcttttttgaaacggagtcttcctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacagtcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccattggtatacttttgcctctaggaccctctgtactgtacttcatggggtggtggggggcgggggtggtatggcatctacttgttgtcccaaggtaaacttactggcttcttctaccaatagagtgatggtagccacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagtttgagagtcttgaagcaggggctgtccctgggttttcttttaaggctaagaatgccttttgacaggctccattgcaattcaaaggcttatgaccactcacttttggaggttcgtagagtggttttgctatgagcccaaacctgggaatccaaacccagcagaatccagctattctcaaaaaggaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgtaataatccatacttcattatcaggggatggatgccccttggagccaaaggtctaaaaggatactggatttttctttttttttttttttttgagtcagagtcttgctctgttatccaggctggagtgcggcggcgcaaggctcactgctacctctgccttccgggttcaagcaattctcctgccacagccttctgagtagttgggattgcagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatattttttttcccatagataattaacactgggtttcaaaataacctggactgggagaacatttgcagttcttccaggaactaccatgtcacaagcagacgggtctacttgagaagtaatatttgatggaaggaacgtcttttctttatctgtgttaagacatgaacttagagctaggagaagtgtcccttcccagcctgtggccttctcttgaggtgctccaaattgaactgcagcctgttattgggaaagtaagtctcttcccagtaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggccccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccgagaagctcagactccgtttggagactgaggcagtctttcctccagtggccctcttgcttacagaaggcacactgattccagcctaggggatgatgagctggcttttgtctgggcatcccaaagccactcttgcaacactttctcaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagagcccgcccttccgggttgtctgggtctacattagtatatttcctgagtgcctcaaccaagcagccctaaaacagaatgggattttcatccttccactgagttacttctctatccttgtcacaattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatacttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtgggggatacaggctggagctagctaaataaaagggagggttttctgatgacattggggtgaaatcccacactggagaactggcaggacccctcgcagaactgggggactgagaagaccctggagagggcatgggccctccagggggtgccgctaggaagggagcatcgaggatatcccacgcggtttcttggtgcctggaagtaacatgagccagacacatcctgcagttgactcttaagtcagaatcctggtagggggccatagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagaagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaaatatttgggcaaaatgtttgggtggctgctgcttgtctgccactatgggtagttgtcacttgggccaggggtccaggaacccctggtccctgtgaccaagagttcaatatgggcttgagcaaagtcacgtaggagggggcccacaactggctgttatggaaaattgtaatcttttaatttaagggcggagaagatgacatccacactcctccagggaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcactaccaagtgtcctgccttaaacagttcttgactctgtcctgtcctgtcctgtgttatatcatgtcctgtcccatcttgttttgtctttgtggtcaccagatgatgcaaggaaggacaaccccaaaattggggcttagcccaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggttattcagaactttttggaaaagggatgaggagtttccagaagcatataaggtaacttcctggccattgccatggcaagttgacatggcatttataaactgtcatggcactggtaggagtgtctttatgctaatgagcagtgagggcaactagaggtagcttttgtctccatctgctggttttggtcagcttctttactgcaccctgtttggaccagatcctgctctgatcaactgggccacaaccgcaaaataagtcctgccactttcctgcctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggcaacctacactttcttctagcagtgagaggtactgagatccgtcaccccctcctgcaaggccaagacccagagagagccaaattttagcctagaattcagccagctcttcacagtctcccatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagataaaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacatatcattagctggaagctgcctctatccatatattaaaggtttctccatatgtagtgaactgtaacctaactggatgtgtaaacaacctgtaacctactcttgagccaatgactgaggtttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtattatatattatatacacatgtaatatatatatgtatgtgtatatataatatttatttgagagagagagaagtgacttgtggtactgatgttgcttgcctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcatgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccaggaccatcaaaagcacacctgcactaggtcattgggaactttggaggtgccttacatctgggcatgcattgaaccaccacacaaggtgaaatgcctcttctcaaagaggcttgcctgcagtttccactaacgaaattgtgagtcatagctgttcttctgtttgagatattaggagggattttgtggggggtgaggggggatgaaagtgagtttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaagtggaaagattgactgagcccagcaatttgagaccagcctgggcaacatggcaagatccccatccctataaaaatttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagcgtttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcacgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaacaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggacaccccactggccaacgggaccctaggcaaaccttataaactgagtcccaggccaagaaggaacgggaggccagacaagcctcattatattcccacccttttgcaatttagacaaaactgaccaacattaatgttatcacagagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaagtttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcattatctgtgggagagttactctgaaagcagcaagaagccattaccagatgcagatctcattctgtcagtaatggcaacccagcaaataggacaggagccccacccaggttggatcaatgcatggctgtataaccttgagcaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcaccattaactccccttcttcaccagagttttctggcacccaagactacagaaactctcctgcagtgggctttggggcacatcgcaagttccagtaacaagggctaagatcgcccgcttttggagaccttacaaagcatgtattccctgaccaggaatcgaactcgagctgcaggcggtgaaagcgccgaatcctagccactagaccaccagggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttaaactctctattgaaaaatgaacaaatgttcagaacagaggaagtagagtggtggcaccatcaaaggcaggaagggccaagagaacctgatgggagtggggatatagacctggttctagcttccagtcttccagtcactaactttctgctgtgtgcagggcacaatggaagtaaacaccacccactatatatcccctgtgcctggcatacagaatcattcatacatgttgaccgaagggtttcctttgcttctaggggattatgtatcattttgggaggaagcatgtattctgtgaggttgtttagtttatgtccaagtgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtactctttatcatatgaggagagtgctaattaatgtgtcatttattttgtgagcatgctaataaatatattcatattccaatttagtgaaaaaaaattgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttctatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagctgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctctctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccatgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatatgaaggaaacatggtaaccactgcagtaagaaaagcaactgctggagaaaatggcactttcttccccaaatttgtttttacactcatgtctaaggaacaccttagaaaccacattaacatctttcagcaaaaggaaattctgcctgttgattttttgctgtgagacaaacttgaaaagttcacagacactgcctttctctgaaaactgcccttacctctttgttacaattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcctgtgtccttcagtggtgatggctctgaaacccttgtgttttatgaacttcatgccctggtcttcaaacgaattcagtgcaggccaagaagcacagtttggcctgggttggatgctctatattttcaaacagtgaaatgccttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcaggtcaggcccttcagcctggtggaagagcaggcagggagggtcctatggttcctgggaggacccgaagcatgatcacctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgtggaaccgtaaatgagggttcagcctgtctgcctgagggattgtgtttcctggcgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacacgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaatcccaagaggtagatgttgcggtgagctgagattgtgccattgcactccagcctaggcaacaagagtgagactacgtcttaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagaagattagacactgcagaaaaaaagattatgaaacacaaagccgccgggcgccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaatatatatatatatatatatatatatatatatatatatatatataaaaattagctggacgtggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaccgcactgaggggaaaagtcaatgtgaaattctacaaaagctgaaaattcactaccaccagccattaccacaaaaaaaaaaaaaaaaaagttgaaggagtcctccaggcagaacgaaactgacatcggatgaaaatctggttgtccaaaaaaaaaaaaaaaaaaaaaaaaaaaactagacatgacatctaatagaagaatatataattttaacatctgactgtttagctgggcgtggtggctcacgcctgtaatcccagcactttgggaagctgaggcaggcagatcacttgaggtcaggtgtttgagaccagcttggccaatatggtgaacccctctctctactaaaaatacaaaaattagtaaggtgtggtggcccacgcctgtaatctctgctactcaggagtctgagtcaggagaatcgcttgaacccgggaagcagaggttgcagtgagccaagattgttccactgcactccagcctatatggaacctagtttgatctggagggatcttattttataggaggcttggagggggaccttttgctttgtgtactcataggatgcacaagacacaagggaacaatctctcactttttaaatacagtgataggcctgaggagaaacaactgcaaattttttttttttttaatgagatgggattctcactggtcttgaactgagctcaggcgaggcttcccctacgtcggcctctcaaagtgttgggattaataggcgcgagccaccgcgcctgaccacaactaaccaacatttaaaagcacgtccctgggtaggctcgaaccaccaactttccggttaacggccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttccacgttagaaacgcttgcattgcctgactctgaaaccagaagggcggccgaatggccttcaccctccgttaaccctcgcctgcttcagaagccagtgcctctggaaatgcctggatctgcgaccccagcctgagcctagtagggcccaagggaagctgaacgccccgacggctctcatggtagctctttctgtttttttgcgccgccttcaggcaatcatctactccgcttgctatcccctcactcaactcggcttcagtagatggggttggtggggcgggagcgggaaagaagcaggggagtcaaaagggaaaacctgaaaagaaggagggagaagcaggggagaccaggacaagacaatgggacagcccaggatgccggtgcagagggcaccggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggggaccgggagcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgtgtcttttggtttgcctttaattcctgcaccagctgcggcctttatctgcagccagaaagcaggttttaccgctggtcccacagcgccatacggtctggggaaaagaaggaaacccaatagtacacaaacaaaggccaaaagagaaaccttccaagtgctctatgccttacggtttagcagaaaatatcaaacaactctcaacctagctggtctgtagcttccacaaatgaaatactgtattcattgcagcctttctggttgagatatttcaaatatttggtggagcttttaatgagacggagagacactctcgagtgtggaagaaaaaaatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctacagggacagcacagcgtcctcgccctggccggacgctcagggtcaccaccctacccactgcccccctcgccattcttccaaaccactctctgccaaagattccaccgacagtcaccccacacgacaacccaggccgcctttcagcagcggctcccgccccgcaaccacgcgccctctcacccccgcggttctgcccgccgcctctatccagtctgtgcacttcacctccctggctcccgctctcccctgagcttacagtggacgcggggttcttccgaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcaccggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccatgtccagggcacgcacaaacgccatgacttggcttggcctctctcttagttattcacagctcagcccgataggcacctccggggcggcgacggcaaagagggtgcccttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctagctgcggaggctgttctacatctgacccttggagcaggccggctgacagcgtagtaaaggaagatttctgcgggagggcggccagtgcaaaacaattccctgaccgggaatcgaacccgggccgtgacgctttcagcaccgaatcctagccactagacaaccatgcagatgcggaaagctgctttctctcccttcttcgacctgaagcgacactttcctgtgctctaggaggacttgggtcttgtgagagtcgctctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgcgaggcggcagcaactgacaagatggtcgcgggtcgccgcgtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccccccgtttgctctgggcaaaacttcgagagttccctctgaagctggagctttttcctcagatccaagatccaattggtcaccaattcgtgatttccgtcggccaagtgcgtgggcattgatctacacgtgagtttctccacctctgccgaatggctacttcggggtgggggaagggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttttcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcagatgcgcggtgcgcggggaagaagaggatttgactgcggttctccacccccggcgcctaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatgtaaactgggtggctaattcacaacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaatgggactaaatccagactcagttattgcaatgtgtgcaaaagaacaaggacttgtactatctgacttcaaggcttactataagctattatagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctccgttcttctgtggttagaagacctgaacccaactccctccccaagcactggagatggggcttttccaagggctagggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatggggtcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagtagagaggagggcaccttttggacagaacctgtgggacaagagcgacgtctcatccgttcaggttcctcacaaaatgagagtcaggaagatcagggtgcagacctgatttcccacgaagggctgaaagcagacaaccagagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagttttttttttcttcttcctttttttctctagctaaacaagcactggccttgagataagcaatgctgaagcacttgcagctcacctattaccaaaaactgactgagccctccctacacaagccataactactgctttgattggacaagagactgatttcagtagttttctcttggtaagagaccactggccgtgggctggttctggacagtttacagaagctatgcacttgattgcctttgtgtccctgcttcaccttttgaagcatagggcctaattataatgtatttaaatgttgtctccaccccaaagtgaacatgggttgcatgtaacaggcgtgtttactcagcatgcatgcagcaggatcccttcacaaatattcagagctccccctattccctgttgaatatgtatatgtggccaaccagatcaacgtaaatcactattcgccctcccctccctggaaacttacttttcgggtttcagcaggaagctatgcctcccagtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcaaataggcctttgcaaaggagaatttcttatatgctggaagccataaaaaaatatgcttcatagtattgctcattaggcaagtacaaattaattccacactgagataccactaaccaatcaccagtgtgtggctacttttttttttttttctgagacagggtctctctcacccaagctggagtgcaatggtgcgattggtgcgatcttgagtcactgcaacctccccctcctgagtagctgggactacaggtgcatgccaccatgcctggctaatttttgtattttcagtagagacggggtttcgccatgttggccagtttggtctgagagcatagctacattttaaaaagttagcacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccagtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtggactaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctacaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcctggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccctccgggagcttcatttcttgttcctctccgtagtggctcagcggtaagcccaaggtccagcacacgaatcaggaaactgatggttcttgggttagcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatatcttttgctgctactttggtcagcgttgttgtcagtttaccttgtggtggccaagcccttaaatgcactattaggttatgcagtgtaattctgcagggcagaagggtaaagagccatagtgaagagcaaaaatacctcttatcttgaccgggaattaaacccgggtctcccgcgtgggaggcgagaattctaccactgaaccaccagtgcctctctctagcaaccctgggagaattatcaaaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcagtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagtagagagatttcttttctcaattttccctggagagattaaactgaagagaaaaattcagagagtttgccccacatgttgggtctgcgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctatatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaatagcgtttaagtttattggatactccacaagcttactgccactttattaccacacttttccatctatcggctcttgcatccattaacataagcagacaaaaaactggactcctggccgggtgcggtggctcaagcctgtaaccccagcactttgggaggccaaggcaggcggatcacgaagtcagaagattgagaccatcctgactaacatggtgaaaccccatctctactaaaactacaaaaaaaaaaaaaaaaattagccaggcgtggtggcacccatctgtagtcccagctactcgggaggctgaagcaggagaatcgcttgaacccaggaggcagaggttgcaatgagccaagaccacacaactgcactccagcctgggtgaaaaagcaagactccacctcaaaaaaaaacaaaacaaaaacaaacaaaaaaaaaactggactccctacagccagtgtagtatgcaccactcacttgccacactgtatgctgagtgacccttccacagcttaaatctgcacataacttcagcctagagccatataatgtccctttatttcttcagtacaatgattaataccatattctctgtacccttcttccctctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagctgattcacctccttggtgagggctctctccctggcttgcagactgctacattctccttctgtcttcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccatcctctgcagtcatcctgtcagtttccattccattctcctatccctggcttgctggttcaatactcttaagtgatttactgctggtgctcttctttttccctcagagataccttgtgatttctttgattctctccacctctacaggttaataagtctaatatttaaaaactctgtagaaggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaaacgcactgccgagaggccagaaggcaaagcgagagtcggtggctatggcctggaacccatttaggcaaaacagagggcgcgcggggacaaagcaatagagaagggtgggcaatacaggatctgtacaccatacattaacaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagagctaacaaaaaaaaaaaaaaaacttatgtttccgcccggtttcgaaccggggacctttacgcgtgtgaggcgaacgtgataaccactacactacggaaaccacaggcggaacctgcacggcaaaatataaccatgaaaatcttagatcagccgtttctattatagtttccaaatccgagatcgcaccactgcactccagcctagacgacagagcgagagtctcaaaaaaaagttgggagaagaaggtgccattttccctagttgcttttcttactgcggtggtgaccgcattgccttcacacctgaagtccaagtgcttccaccctgcagaatatgcagaccgctgggtcactggacgccaggccgcagcgccggcctcgttctgcttttggctctaaatgcagtcgggggacgcgactggacctcaccagagactggtgggctgttacccttaccagcgactggagggccaagctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatcctcacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccaaaggaaaagcgcaaaggcggcccaaccccacgacctgagcaagccaagggtcgcgggttaaattgcgtttatcagaacagttgtttgctcactgtcccaaagccctcctagggacaaagaaaacactggcatggcaccaatcgcagaagggggcagcattgacacccaggaacaggagtggaaaagcaggaaaagcagggatcatctctctcctaccccgtatatggctgcagacatagcagtggttcttttctccaggacccagtgagtgtgcaccaggagagaaaattatgcacgttattcatggtggcaccacccaggctgaaagtgagcctgtgctgcttgggctttcaggaaggacggacccaactctccctccctatacagagctgcagtgccctggcaatggaggacagaccatggagttgcctgccctggactcggggaagaggctctgccctaaaccccattttagtggtagctgtcagagtggcatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactgaactgcatcctaaactggaccactgaattcaaaaaccctgctaccaaagggcttagtgctagtccatgagataagtttcctgagaattccgtaccctcagcccccaacaagggttagtgtgttagcttttacttccaacacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaaaattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgttggaaatgacagataagaattccaaatacggattgcaagggaactcaatgagatccaagaaaaagttgaagtccaatgcaaagaaatcagaaaaacaatacagaatatgaaagacaagaaaactatattaagcaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccattgaaaagcatacagtcatcagacttcccaagataaatgtgaaagaaaaaatcttaaaggcagctgaagaaaagggccagattatctataaaggaaatcccatcagactaacagcaaacttttcaacggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatataaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaggcatagggtggcaaattgggaaaaaaaaaaaaatcaaactttccatggcctttaagagagacctatcttacatgttatagcccccagaggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttaaattggactcttgactaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaaattgaaacaaatgaaagtagagacacaatgtgccaaaaactctggaatatagaaaaacagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcgagcagaactaaatgaaacagagataaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttgaattcctggaagcacacagcttcttaagattgaaccaggaagaaattgaaatcctgaacagaccaataatgagttatgtaattgaatcagtaataaaaattctactaatctgaaagagccctggaccagacagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaattctcaacaaaatactagcaaactgaatccagcagcacatcaaaaagataattcatcatgatcatgtgggctttattcctaggatgcaaggatggttcaacagacgcaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcaggttacaacatgagcatacaaaaatcagtagcatttctatacactaaaaatgctcaagctgacagccaagtcaagaacttaatcccatttaaaatagccacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcacacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagctgagatcatgccactacactctagcctgggtgacagagtgagaccctgtctcaaaaaaaaaaaagaaaaaatccccatggaaccaaaaaacagcccgaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaactaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcttatgactaagacctcaaaagcaaatgcaacaaaaatgaaaattgacaaatgggacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaattctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaaccttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcgccacagccagaagagtgactctgagtatatgaatgaggggctacagtggactgtccagtacctagggagggagagacagggctgcaatgaagtctggagggatttaggaaattcattgattgtaccaaacaaaaacttacatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacacgtaggtgggatcttttaagaagcagccttatctagattgggaataagctattatagttttaggctgtgtggatctggtcaacttttgtgctgcctacttctctttgcttctacaactgggcattgctgcagaaaggaagaaatatggaagtgacttcagctttgattttcttccttctggaagcctgaaaactccagtttgcttccctgagcccttttcctgttgcacaactagggtgtggactacaggtcctacccatggaagatggaggtagatacttcacagggaataaaaacaacctagacaagtcatacctttaggtaacagatactttcaaagatgtactttcctgcacccattaaagttttagtctcagctaatctgaaaacctgcggtcctcatgcactgggatagcagtgcaatatggctcaggctcaggttttgctgggcacaccagagtaggccacacactctcatgtgcagtggcttcaggtatggatcagggtctttcccactaattggcttcagttatgatgttgtaggtcatcattcttctggctttaatatgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctccagcctctccctcaggcggtcattgagactgatggactcctccaggcgctggcgcaggttctgcatctcagcaagattcttttccagcaggtcggcccctactgcaaaccaccaagacataggagaggtaggaggtagggaagcctgatcatccctgggcagctgtggggcctgcctggcaactctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagagggggaacaggagagaagggaacaatctccaaggaaggaaaaagatgcacagagagaggaggctgagaataggcctcacccactgggagattttgcgtagggtcaggtttttctctgagaatttaaaatgtcttattgttacactacctgggacacagaaatggagctgcttcaagccattcctctaaatacctgcactcctagctgccaggtgccaggatgtttggctccaaatccaaaagcaatgtttatgggggcaggattggcacgtggttgtatgcacagtgtgtgtgaaagatgtgtgtgaaagagtggaaagagtgtgtaggggtgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtaagttcctaggtagggtggctaggagaaggcactttcaaagaacaagcactgagctggttctcactgtctggctgatctacatattgtcctgtcattttttatgaaccaggttctaacagaggaaccaaaaagtcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaatgagtgttttaaaggtaattatagtgagttgaatagtgtcctccaaaaattcattcagttcacttggaacttcagaatgtgatcttatttgtaaatgggttttttgtagatataataagttaagatgagatgatagtgaattgggggtatgtcttaaatccaacatgactgatgtccttatgagaggagaggagacacagagataaagagacatacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttaggcgtcttcatctccagaactgtgagagaatacatttctgttttaagatgcccagtttgtgtttttttgttttggaagccctcgaaagctaataaagcaatccacggaatgaagactaaggcagatgtcagcagactcatttcccaaggactccccatttcaccctaaagtaactggcatttctcagcctatgacataagcagtagtgttagttgtaatatctgagcatcacagcgcacatacaggaaaaatatggggcccctctcctagcttcctttatgattcccaatgctggaatgaacctggggaggtacttcagaaatgtttctcctaatagcaggactcacagccaatcctaggagttcagacagtgaggggtgaagcattttgttggtctgtaaacaggtgactatttattcaacattctatgcccttgccagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccacagaatagctagtgtactcttgcatagaggattgtagaatcacaaaatacatggcatcttacagctcaatgatgccatgagaacatggccagatcctctgggcccttcattactgtctccctttgagagaaaaacccagctggggtggcagggccataattcagagaaaagttttagagtctttccctttcaaggattattatcaagggctaaagaatagacaagtttctcctctgagcaggtgggagtgaggtttctgtttgccctcaacaacatcacgttcttttaggaactgtatatttaaatcagtaaccagtaggtctctccttctccaatttataaaatatcagatactaattagaatcactgtgagataaagagtaatgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacattctctggccataccacacggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaaccgttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttcagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaatccattatgggccgggcatggtggctcatgcctgtaagcccagcactttgggaagctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactctgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcctcttcccgtctctatcaaggctatcccaaggaccctctcagggaaattctcaggagggacacgctggttggtgatagactcagcttgaacctcacagcatggccccattcactgatggtttagagggtgttacagcaaacttattaggatgatggatgggatctgtaaatgcataaatgataaagatgatttagtgatgaacaaaaaataggaactgttgctgtttaccccagggattccaggattaggtgcacaatgttagcaacactcatgtccctagtttgaaagatgacataattgtgtgcagtgaagaggaactatttgccccctttctccccttcccaacccatgccccccaagaccaagaccatgtatgtgccagaggagatctagtgactgatggcatgtgagactgggaacggagaaaagctacctgaaaaccttggggcttatgctcagcactgagtcctggagctgtgcccgaccaggtacatcacggtggatctacagggcccggctgcaaagatgccacctcttggcctagacaatgcatgagcccccaaaaactggagccatgtggctactcactgactacagtcactgaaggatgcacttcctccttgtcaagctgtggagacgtgctgctcagggagtgatgtggggtagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctgagggctcacaggagatgtaaaggggaggtcaagaggatcattccttcagaggagaagccaaacaaatcatttctgtttcaggatagagtatggagggaaggcggggacagagagagcaacagttgtccggtgcattggctacaaacatcctgaggaaaaacgaagccgtaatgggccccttaaataacactcatgattccttcacaaaacacccagagacccataagagttcaactccaggtatgggcatggcggtacatgcctgtaatcccagcaatttgggagaccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcatgccactgcattccagcctgggcaacagagcaagacctcatctcaaaaataaaattttaaaaatgtaaaaaaaaaaaaagaattcaactcattctgtgaacataatttttaaaatagtatttgccataggccatttaaaacagattccccaggcaatgtagcctcactggtgtcttgcagtttctagatctccttccctaagtatagagacacagtataaacttttgtttgcaagaaaaatttgtagccgttttacatcttccagcgctccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatcactaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggaccagagacttgactacctgatgcttgccttgattccaggatactctgaattttctcagatcttgggttgagtctttagagagcttgtctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgttccttctgtctttctgccaattagtttcagaggaataccatcatccctggggatgcctcctgccctaacagtcatattccatgagggatggaggtgctggtgatcatcatggcatcctcaacccttcttcttggagctcctctccagccagtcctgactctgtcatggtcttaaggtggtgattacaaagcaggacaccaggttgaaaagtgacatgtgaatgggggtggcatcctgtgaacttaggaccttgggagagactgaaaatcttcctaagctctgcggccaacttacctgtgctgaattttctggcaaggctctctgccagctggcttcctttggccagctgctcgcagtagtgctgctccatatagtggtcaaagttattgctctggagtagctcctcaaaggtctttagtgtgttcttgacatgctggatgagaagagcagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaatctctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttatctatgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaggccgggcgcggtggctcatgcccgtaactccagcacttagggaggtcgaggtgggcggatcatgaggtcaggagatcgagaccatcctggctaacacggcgaaaccccgtctctactgaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagaggtcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaatagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatgtttgacaaagggacaagggcaatacaatggagaaaagatagtattttcaaaaaatggtgctggaacagcgggacatccacatgcaaagaaagtgaatctagacacagacttcacattcttcatgaaaacttactcaaaatggatcataggcctaaatgtaaaacataaaatgataaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttacttgttggagggcatgatcatggctcactgaagcattccttgggcatgatcatggtgtgattatggctcactgcagccaaactcttgggctcaagtgatcctcttgcctcagccttccaaagtgctgggattacaggtgtgagccaccgagcccagctatatgattatttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagatatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagtttacacaaaaacctgcacatgatgtttatagcagctctattcataactgcaaaaacttggaagcaaccaagatgtccttcagtaggtgaatggataaattttgatacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagagagtaaaaagatcagtggttgccaggtgttaggaggaaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtgggttcatcagttgtaccaaatgttatcactcgggggcaagatgttgatagtgagggaggctgtgtccttgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattctaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgttttgtctgagatggaatcttgctctgtcatccaggctgaagtgcagtggcgctatctcggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgtgcctggcctagcgttattttagccctaactaacattattctctgggtcagtgaaatttaagtggaatatattgggcagtgacctaatggagcatgaagcaggatttgaatcacttccaaagctgtacaccaaccacttaggcaaagtagtgatttcagtaacttagtatttcagtaactggtgctcacaggcaaatgcgtaatggattaaccccatattatttaaatgcttccaaaaagctataggaaaatggccattaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacgtatgaagaaacaggagattcctacatgctcctggggatccagaagagagaccactcacatgactggaagatttccagctcaggtaaccacaaaggccatatatttggtgaatacaggcaatgttagttagaataaaaccaaatttctctgaataatataaagtcattactaataaaacttttatagatttttctctgaagaaatttccaggaaggtgttaagagaaagccctacaattaaggtatggaggctggctgcaggccctgaaagctgctctgatgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcagggtgggtgctgttatgagaaggaaggggaggtcccacaggtgtttagaagaaaaagcaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttgagatgccagagctcaaatcccatgtcactgggacatcaacaatagtgctatggggaagactcagggtgccagctcttgagtcacaatcacagaattagaatgtggaagtagctacagaacccaaggaagccctgccttctgatagctacactcaatgcaaggctgcgtatttcaccctggaggtctctaacaggggaggccaccccctcaatagccagcttttttacccttttgcttacgttgtcaaccaatttctaaccacagcaaaataacctaagtatacctctccttgaaaacatcaaaacattttctcagcagcttttattttcttgaagacaatttcagtaaaaacaattcttgtggcttttcctaaatgaatttttttttaacttctagtgattcttactcttcgtttttaggaactctccaggttttcacttcctacattctttcaagagtatagtgactaaaactggagaataatcatttaagtctgactaataaatttagcctcatgttgtattactttttaatacataataaataatatatcccaatgcgatacttgcttcctttcccttgcagtagcaacgtgtaggggtttcatttaatatgaggtcgatttgagccttccaaactcccattccacccacctttgcttgcactcatgggaaggctcagtctatatctggtttgcccacattcctaggctacagacctctaggactcccagtttgagaggcgccatttttttggagggtagtgaattttgatttctgtctcctttgcatccttcccagtgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacacgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaagagaagaggccattggtagtatatacttgcatttttcttgtaatacttgcataagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattgtagggaatgttaaaatttctcactggtacagttagaaatgaaaacaaagacaataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatctattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggatatatactcaaaagaactgaaagcaaggattcaaagagatatttgtgcacctgcatcaatagcagtattacaataactaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggacattatgcaaagtgaaataaaccagtcacaaaaggaaaaatactatataattctgcttatatgaagtacctagagtagtcaaagtcatagagacaggaaataatggtggttgtgccaggggctagggagggaagaatgggaaattaatgggtatagggtttaggaactttagtctaagaaaggagaatattggatgccagaaattcagttttctttctgttccaagatccctttagctagagcgacatattgaagtcagagttcctaagggaaaatcattgtgtatggagatcatccttgtggatcaaatgtgaatcaatagtagatcaaaagatattccacttttgcagatattgacatttgttggacccgtaagattttatctagtattagatagataagatgtgaaccacttctcaacgctgcagactcaaatactaggaaatactaagaacctcaggacaaacaaatagccagtccaaaaagactcacagactagataagctgtcatctaccacctaacagataatgtatccctgttaaccactatctccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataaggtgcaggattctattagctaagattatgtctcaggtgggcaaatctctgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagtctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatacaaaatatcttggaagtttagctgaagagatgaggagatactctactgctcaatgtgcgccatgtcatctgttgtacctccccttagttaagtcaggagggcaacactccctttattttttattttattttgtatgtatgtgtgtgtgagatggagtctcactctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcggcccctctatttatcagacagatgtatagaaagtttattgtgctagcaagagtatgaagaaaaggattctctgagttgaaaaaacaaattggaatataaattggtaccacttctatggaaggcaaatttacagggcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgatcgagcaattagtaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactacatttctttccaacagagaccttcttggaggatgagaagcagccactagttgacaggaggggaagtgaggcatgtagtcttcaagggagcagaccaccgtgggagttataaaagaccagcgacgcctctgggtgggttcgaaccaccaaccttttagttaacagccaaacgcgctagccgattgcgccacagagacatggctgagctcctaatttcgttctataagagggtaagctgtcactaaacgctagctagcaccatccgccttttgcaaaatgactgggtaatctccaaagcctcggaaagccggagcagtcagagcgacgaatctacttgtttgtcaagtttgaaacctgtgcattgagtgattccgaaacgccccgcaccccgccttgcctgcctcagaagccggcgcttccggagatgccgggatcgcgactcctgttagagcgacttgggccccagggaagctgaaacgcccagggcgctcaattaggacttgttgaattaataatacatttgagagacagaatatacaatcgaacaatggccggactatacgtaaaaatataactctgatccacaacctggggccacctgcccaagaaatcaacttccttatgtacgaataaacaaccggggaagccagcctgctattatataagtcagactcacagggagccaggcagttatctgtagtaacaaacaataacatccataacaatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgacgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctagtcaattgatttccaagtgtgcaatgtcccatggggtaggccacaaagaggcctagagtgcaccatctgtgcggctgcagctcctggctctcaacagaactgagatctaagtcctcatgatctgatcagcttccaagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcctacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatatttttgcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacgtaatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcactgttctagaggctgggaaatccaagttcaaggtgccagcagactctgtgtctgatgagggctcactctctggttcataggctgtgccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagtggggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagtcttaacaaggcttaccttctttcttgtggtaattttttgataagcagtttttaattttgatgaaatccaattttcttattttttgtgacctctaagacatctttcctaccctatgattgtgaatatattttcctacattttcttccagaaacgtgtttttatttttatttttaaatctataattcttcttaatttcatctcctgatctcagcacaatgcttaaccactataaaatccacaacttgcagaccaacagttcaatctcccagaaacttgtataacccttgatgtaacaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcgatctttcttctgtaaaatggggctaataagagtagtcttaggccaggcgtggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggcggaggttgcagtgagctgagatcacaccactgcactccagcctgggcaacagagcaagactccatctcaaaaaaaaaaagaaagaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttctttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatttgtgtgtgtgtgtgtgtgtacatatgttttaaagtctcttggaagaatatctaggtgaagaattgctaggaaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtttccatttctaatactgaattgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattgctttagtaccttttttgaaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacagctcaataaacctgaaatgtgtacatcctatggtgccaccatgaaaatcaagacatgctgtcacttaatcgctctcatttcactagaggacacatgagctcatgaataacggttgaccccttagccaaagatcctctattgtaccctctggagaaaataaatctctagttaccttaaaagctgatctagaggtaaaatgtctgcaacattcagcaatgaatttagattatctttgaaaaaaagttcattttcaagttgttttttttgtttcgtttttttttttttttttttgccaaagaatttctttttttttctgttacttagtagcatgaagtacaatgtttggtttgcaatttctgttctttgtaggaagaaaaactttagtggaaacaaccagtacttaaagaccattttatgaggctgtcatttacgtattatctcttttgctgtttttgttaaaatgatataaggtgggctttatatgctttctgtatatcctttggaatgtgtatttaaattaaaaacttaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttcctcccacccttgaaagtcctcgacttaaaacccatctagaacatttcctttgctaagactttaaagtattctttcttcaagttaagggcagtttttaaatagttatcagttgcattcttggaattcacagaaagcttggggagaaacaatccaacggcacaagttcaagtgcccaacggggtggagaagggactgcatactcactggttgccaggccgaggttgtccgccttgcctgctttggctgagactggagacggaaactccattcaacagcgactggaggactgaaacagggcgcaagagggcggctgcccttcacctaccggtccctccctgccttggcgccttcggagttcggactgacccgggatgttgctggagcccgcaggaactgcaaactcaccgcgcgcgtccctgcacacccgcacctgcgcctcgagaactcctggccagttgaatacccggtcccccgccgagcttcgctgcaggtcacaggaaagaggtgcagggttgcgtacccggcgggagaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggatggagggagggaagaaagatgaaaaaatcaaccaaaaaaagaacatgatttcctaactaatcggatgtgggtcatgagagaaagacctgcgtcgagtttttggcctgaacgtgtggagggtggagttgccattaactaacgtgggaaaaggcaggtgtagtacgttttagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggcgcatctttaggtcggtagtgaggtgcggccgggacgctgcaactcgctccgggacttgtaaacctggcaggtgttcgaagagggccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtaatttctgctgaaacaattgaaggaggaaaaaaaaaaaagtatgtgctttgtggttccctggtagtctagtggctaaagtttggcgctttcaccgccgggactggttgattccagatcaggggactgggtctcggcctcactgtgaggtattgttctttcctgtgtttgccatctgccaccgctgtggctcaattattccaagactgctggagaaatggaattaatgtcgatcctaaaatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttggaaccaatgctagaaattatcagtcttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatagtctcatgggtatgcttgagactttaggcccttgggacacctggtgcacagaagggtcccaaaacccatctttggaagtgttggcagagtaaataggcaccagtaataaaggcaacggcgcctgaagacctaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttattggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatgtatacgtgtgtgtgtatatatatatataaccatatgtaatttcaaaaggtaaattaaatataatgggacagtgttggtaacctcttagatagtgtagggctaagatagctgaatttatggcatggtgttgtatacttcagatatctatgctgtaatattaaaatggcatttccttggcccactaaattgtccatttcctggcccaaaaagatacgcgaaaggagtgaaaatgggaagaaaatagccttttgaaggacttgcctaataaacttctcccttagcattacttggagtgacatcagaaaattggaatgaagtaattgtgtaatgtaaaaaagacaaattctctgctgtctttctcccccaatccttaataaacaaaggaggaaacctagactcaggttaggttttctcttcttattctttacataccaggacaagtactgagcttgtttgttactatatggggacttagtatattgtacaaaggggtgtggctattactatcccttttctaccagagcatcaaaactggtaacttggctggtgttaacgggagcttctaaccttgaattcccactccatgtgacttctttctggttctctcttctcagagaacttgcagccatcagattcatttggagaagtttgataaaggttactttacgcttagacagaagaaaaaaccctaaggtcttgaactgagccttatcctctgatacagtttactggaattccctccactgtggcacaagccctgctgtaaattgtgattatctataccttgtcagttttatctatgtatatatcttttacagtaatccccacatccaccagagaacctaggttattggcagaatgaggtttgggaattctggtcctctggccagacactatcagttagtactctgattccaccatttttgaaattatatacaacaaattttaagtattgtttattttggagagttcaggttaaaggaaatgaagactattattcagtattatttctgtaattttgtaattttaaccataacataggtttcttatcaaaacgtatggaagccagaaagcagtgaagcaacaatattttctccaaaacgaacaggccaaactttggcaggagtgacaaatctggcatgcaatggtggcttctatatcagaaatcaagtcttttactttgtgagagcacgagtttttagttttttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgccccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagatgcagtagagagacttctttcgttaaagtacctgagtcaggttgaggggaagagaagaattaggagcacaaagagagcaggcacaccacaggaagcacaactctgcaattgcttttggttttaagaggctgtccattcagtttttttgggttttttttttccttttcttgaaacggagttgcccaggctggagtgcagtggcatgatctcagctcactacaacctccacctcctgggttcaagcaattctcctgcctcagcctcccgagtagctgagattacaggctcctgccaccatgcctggctaatttttctatttttagtagagatgaggtttaaccatgttggccaagctggtctcgaacccctgacctcaggttatccacctgcctcggcctcccaaagtgctaggattacaggcatgagccaccatgcccagcctgtccattcagtttcaatgaactttaaacaacaaaaaatgccatttgggtggctggtttcagtcttccctgtcaatgctcagcctccaaatattcactaacacatagaacaataggaggactgttactctcctctcacacctactacttgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacacccataattccacagcatgacaccaaactggagttactagatgacaacccaagtggtgggttgctctgtcaagaaggggccaattttatattgcagctaggcagttacagtctgtagctgtaccattgaggggatcggggcaagatgcaaatttccatggcttaccagaaacaggtgagaaactgcctgctggtagcctgctgcaagacaaggaggcccccaaaagagatgagtaagaaatagtcttatgataatggctcacaagactacttcccttaccatggtccaggagggcatttggtcaaggtttgagtcatagtatggttgagccttgcctatgtaaagtttaagcaaagccattcccttgtaccttgtaccttgaagagagtttcattggatataatatccttaatttgcactttcttctttttaatgagtaaattgcattttattttattttattttattttattttattttattttattttattttttgagatggagtctcactctgtcgcccaggctggagtgcagtggcactatctcggctcactgcaagctccacctcccaggttcacgccattctcctgcctcagcctctggagtagctgggactacaggcacccgccaccatgcctggctaattttttgtatttttaatagagacggggtttcaccatgttagccaggatggtctcgatctcctgacctcatgatccacccaaggagtctctctccctccttgtgttctggtctgtgaatggctcacacttgaacttagtgtaggctcctagtgggaggagcaggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactggtggaagcctcagggcaaggccttcacttcccagtgacactgttcccaattccctccagcatgagctgagcctcctcaggctgtggttgtgcagcagacagggtgtgaggaaaccctgctcaaccctggttacccaggatggcactgagttctaaaaagcaaaggttatgtggtgaggggcctggctgaagacctggtgtggtacttttgtgagcagtggcaccaatagaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaaatacccaacgtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagctggccacccaaccctaatcttcttcttatgcaaatgggttttctactttactcgcaccatgttgtctgctccttactgtacacgtggttagaaaggaaaagggaagatggagccaccatgttgaacatgcctaccccccaggtagccttgtcctattggcacagccgccagcagtcacctgtgcaagcttccagcttgcttatctatgtctgcagctccattttacaggctgctttttgttagaaaagaaattatttggtggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgtcggccttgtaggtgtggggtatctctagcaccagaggatcattgaggttggggatgcagggcagtgagcagatggacaagagaacttttgacagtcaatgctggagaccactgagaccataggatgttgaagcagatgctgccattgctattgatattggggtgataaattttggttgtgaaagcaacctttgggggcttgaacaggcaatccataggaaagtggatggtcaggaagaaaacacctccttggcaaggactgtcattaattatcacccagaggccccgtggagcactgggcaggaggattcgtctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgcttttgtaacttgttccacagtgatgcctggagacctgagtatgttttatctttaaaatctaataatgttactaggatattgtcttgaagttgatcatcctggtttaatttttgctgccactttatgggctctttcaatgtgcctcatcacataagtaatgtcattttcatttttgtaaatcaagtctcctagattgttcacctgaaagcctgattctcctttagagaaaaaaatgctaaaaaacaaaacaaaacaacaaaaaaaacaaaacattatatatcgcattacaattttattcaacaaatacagaggtttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggagagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaattaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttcctcgctccatagtgaggcgtgacccagcggtcagcccaaggtctagcatgcgaatcagggacgtgatggttctttgggattctagggatctacctggagaatagatgaaagtaacaaaagttttacataccaatattcaaaactgcatcaaactaccagaaacacttgccactttcaaagatagactatgctaagtagctccaggtgtgtgccaccatgcctggcaaatttttgtatttttagtagagactgggtttcaccatgttggccaggctagtctcaaactcctgacctcaggtgatccacctgccttgacctgccaaagtgctgggattacaggaatggctcttgactctaactgcaaggtccctagatcattagatcatttcctgaatatcttatgcttcaggcattggccatcacttgggttaccattgtcataaatcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccacaaatccggctcttatgtgtggtcctggagaaacaattgaaatacaatactgaaaaagacagaaattgttccaaaagaagctttttgcagtattgactaaaagctaacagtagacatccaaaaccaaggtttttacagaatacttttactagacaaaactataaatattaaaatagcttatttgatcaaactttaattccgaaaaaggctccttccaactgcgtaacagactcctatagaaaaacatcagaaattcatccaggttccttgtttctgatcctaaatcttcaatttaggacctcaacctcaaactgttgctttagtggctctgggaaggaagcactaactggcagcataggtaagtaaagttttaatctagggaagaaataagaagcagaatcagaattagaattagaagaaagagggaatatgctataccagaatatcataggcaaaaaaagaagacaaagaaagaggaaatgaaaggacagaaggtaatgctaatggagttagttatttgtggccgttttttgtaaaagagtaatgatcagtcttgtaatcattataatactattatttgctttctaaaatgtctaaaatatttgaaggaatttatgatataaaaagatgaataatgcttgcagtcagtgtttcattgtttgggagaacccagtttcctcagttaatacactttcgtgtaatagctgtttaaggagtaacatggtttaaagacatattaatggctgaaatattaacatattggtcttttgatgaagttcaaatagagagatttctttccccaattttccctggaaagattaaactgaagagaaaaatctggaaagtttgccccacatgttgggtctgggagtcattatgattttttcaaagacaggagttgtgtatgacatggaatcatgcttcttctctagttgagaagccaagctaggtccaggctgagtcataaacttgaacccaacaaggaaatcacccttcacactggccttgcagagctttggctcaatctgttctctgcccaacacccaagacacatactagttctggccaacaaaccttcacatattgtctgtgtcaaccagagctacatttattccgaaatctctttctaaaatacaaacctgtactttctactctcaaccccaaaatttacaagaggcctcatatgcatctcagagtcacagatgctaaaactcaacacaccagtgagttccctgtcagcatcatatactaccctctacctcaatgatcagccccaagccagcatctcccaaagagtagtgtgttgctgtgggtgtttcaacagatcactaaaacctgcttctacccctgcctagacacttatcctcactgctatgcatcctgctcctcaaatcagatcttgatatcttctttaaacactcccaatctcccaacacgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtatcctgagtgacctttccacagtgtaaatctggacatacctgtagccttaaatcatatctaccaacatagtagccaagcaacagcaatctcttttcctttggtcattagagtcctagagaccaagaggatgttgggaaaagaattaccatggatcagctctcagaggcagtaggttctggactcatgctggctttgatacgtgtgcattggaaaagctcaagtacctggcaatacttggagattaggaagaaaggatgaaaataaaccactgcactaaataacatgacaataatcacttatacaaaaattttaaagataaggaatatttaaagatttattagtttattatagctttatagttggagagtgaagaagaaaataccaaagctttttgtcttaacaaaatggtgcagacagattaacatatattgtcacctatgataaccagtcagcataaaaagtatttagaaaggaatggttatattctctaagagatatattctgatgtcatgttttttgctttagagtctattaatatagccacctttttgttaatgttttcagtcaagctccttttctcgcctttcatttccaacctttctctcactttctggtttagatacaactcctaaatatatcatatagttaatttaaaaatccagtgtagcagtatttcgggggtttgttttactggataatttggtccacttacatttaatgtaattgttgatatatattaattttaaatctaccatctttatttttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatccttaatttttttttttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtaataattgataccgttatcctcttcctgcacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttactctttatttctgctatgtctctgaatttccatatgtaatcatggtccttctgcctgagaaacatcatttagaatttccttttgtgttggtctgcttgtgaaaaactgtttcagctatttttctctgaaagtgtctttatttgctttaattattggagattatttttactaagtatgtaattctggaggcagttattttctttcagcatattgaagatatttacatttgattgtttcttttcagaaggcagccaattgtctcgctgctgcttatttgaatgtaatgttcctttttttcctctgttttttgtctttactatttttgtctttgtttttttttttttattgtctgcagttttactactctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaagtagactttctcactctatttgttatatttttgtgtttgtgtattaaatattattttttctccttgttatatattctgaatttttttcttcttcctcatctcccactttactagttctcttttcagctgtgactgctctcctgttaaactcttccattgagctcttaattttgttttgtttttttttttccgaatttctgtttgcctctctctaaatctattctgtcatttttttgttgtttccaattggtgtgtaaattgttaacaaaacccttttctccttctgcatgataatttgaccttaattaactttccagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctgatagcaagctataattcttatcctacatctctcggattaatctggtgccaagtatggcctctgagattcttgtgagcctgaacgttaacttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagttcatttttatcccaagattatagaaatgtaaggtcctaccttattgtaggattattctcctgataaactccccaacttgggcagactctggtcttctatttctgtcccattagtcacagaaggctgtcaaaccctaatatgcaggtcaggaaatgtccttagccaaaaaatggcttctctgcttgcttacggctctgggttccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgttcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatttgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactatgctgccaaagtgactcaaactcaaaaggacaggatgagacttactcagaacttcgaggaagtgtagagaaattatccaccactttttatcctagaggtgcttttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaagagtcaagtctatgacttacaagcttataaagatccctcagatgagttatgtacatggattgagaatcagaaaaggaaggatgctctctcaggagatagaaaaaccagataaaaggaacaactgaaattatctgacccatcccctcatcgcctgtgtagaagggaaatgcttactttatctaaccagtggataacagacagcctctttcattttggagctaccaaaaagaaaaataaattgtggtttggttcagttcccttttgaccagtatgttcttgaaatttcgaaaacattttactctttttccttttagtgtttcagtgtggataatttcatttgatctattttcaagttcattttttaggccaaaatttgtcaaatattggcaatttcatatgattcaacttaatatattaacctaatgtgccaaattcaaatttgtttctatactactaaataatatcccccgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttatttaagctttatatatttactttttacctgttaattgttgtaatcacccactaaagagtaaattctggctgggcacagtagcttacgcctataatcccagcactttggaaggcccaggtgaatggatcacttgaggccaggagtttgagaccagcctggccaacatggtgaaaccccatctctactacaaataaaaaaattagctgggcatggtgatgcacacctgtgatcccagctacgcaggagactgagacacaataaacgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtatcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatgtaggaggatgtgtatgaatgagcatgtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcctttcttacaatcccggagccagcctcatggccccctctcaaaggcatgagcatcagccagtggacacctcttcttcagagatctgagtccctgcgacactaggtacttcctctgagttccaaggccaccagcaacctccttctcagaagccatcctcccagttatgtgtggcccttcatccaagttaccaagttctaacaacccaaccattttacctttgtttctacaaccctagggttgatcactgcttcgctttctacacttactatctctgtgttacatcagttccccttttgccttcttagacctccaatacctgtataattccttgtgttaaattccctctggtatactgttcattttctatttttttttttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgatcctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaagagacttgattaactcacagttcagcatggctggggagccctcaggaaacttacaatcatgacagaaggagatgcaaatacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttcccaaaagtcccccaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagagattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactatcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagatcttgtcctctgcacacctgcaggaccaacaccatgtgaaagctgccaaggcttggggctcgcacccgctgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagacactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagactgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaaaccccttataaaaccatcagatctcgtgagaatcattcactatcatgagaacagcatgaaggtaactggccccatgattcacctacctcccactgggtccctcccatgacatgtggggattatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttgtaaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaaagaaatgaaaaagcaggaacacatgatagggtagtctgagctctgtacaaataggaacagtaacatagacaaggagtaattagagtaggctgaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaacattattgaatttttatctaaatgtgatggaggatggacaggaagagaattactgattactctcagtcaggattcatcctagcagcaattatttgtaatttaactgaaataagtccatttgactgaagagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaattgttatacacccttcctcacagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattattttattttattttattttattttattttattttattttattttattttattttttgagatggagtcttgctctatcacccaggctggagtgcagtggcacaatctcaactcactgcaacctctgcctcccgtgtttaagcaattctcctgcctcagcctcctgagtagctgggactacagatgcatgccaccacactcagctaattttttgtatttctaatagagatgaggtttcgtcatgttggccaggctggtcttgaactcctggcctcaagtgatcctcctgcctcagcctcccaaagtgctaggattacaggcattagccaccgtgcccagcaattcttttggaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagactgccatgtaggaaacaggatgtctctaaagtgaaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacaaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtacaacatctgctactcctaccaaatgctaagccactatgaggatataatgctttatttttatttatttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgtttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacaggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacgtgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcgcagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaaatttttttcaaggaatagaaccactgcacatgctcctcctgatcccccaaagtgtaagattttcatgcaaatagctatctcccaggacttacattagtaaggtatctggatataaaaatcagtgttccctaaatcagctgtgtttccattatatcaaaaataaacttttagaaattaccatttgaattaacaaagatacacacacacacacacacacacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatcatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagaaatagacaaaagtgcccactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttcaggccatgatgggaagggggagctgaacatgcctcatcataccctcctcccttttggaattactggtagaacagactctaagtctgataaaaaaaaaaaaacatttacaatctattctctctgaagtctgctgcctggatacctggaggcttcatctgaatgacaaaaccttcgtctccacaaccccttatcacaagccagatattcctttctattgataataaggaattgccaatcagaaaatctttgaatctgcctatgacttggaagccacctcacccctgcctgctgcttccagttgtcctgcctttccaaactgaaccaatgtaccttttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcacatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcagtaccttttaaagatgttgttgctacattgtcttctcacttgcattatttccaacaagaaatctgatgttttctttgtgcctctgtgtgtagcatgtctttttatctccgatcacttttgagattttctctcactaactttcagtaatttgattattaaatctttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagatagattaacaagagaaaagcagataatcagggaaaaatgagtaactctcaaagaggtggcctagaattttggcttatgtagcatcttcaactaaaagaaagaaagaagggtgttgggaaagcaagctatgggaaagtgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactccgagagggttcttggatctcatgcaaggaagaagttggagtgagtccatagagtaaagtgaaagcaagtttatttaagaaagtaaagaaataaagaatgactactccataggcagaccagccccaagggttactggttggctatttttgtggttatttcttgattatatgctaaacaagggttggattattattcctttccaggaaagggggggtgcaattccaggaactgacagttcctcctctttttagaccatatagtgtaatttcctgatgttgccatagcacttgtaaactgtcatggtgctggtgggagtgtcttttaacatgctaatggttataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcatttttttttaaccctctgtttcattttggattgtttctattgctctgtctttgcattcattaatcttgttttctgtggtctaatgtgctctcaatcccatccagcatactggtattcatctctagaagttggcttttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacatgcacctgtgaaattaaaaaaaaaaagaagaagaaactttttatctgaggaatgtgagcccctttaaattatcaggctcggagaggcattggaatgaaactgcagtcacatcactcccccttgagtgattatcttgtaaagccacttgctatacgggctccagactaactgatgccaagcagccataaaataccatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtaggtgaggcaattgcagggctcatcttttttcttccctatctctcaggggtgactgtcttttgttgcctgatgtccacagtttcaaaaaacattgtttcatgtattttgttcttttgtttaattttgtttaattttgtttcaggtgagaggataaatccagtctctgctactccatcttggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatacactaagtgagggtctttcagaatagcgcttcagtgtctgcacctgactcacactattaggcagttaaaagctggggaatgagctcatgtgaagagtttttccatttcagatgatagctatttttaggaacacaagctacataaatgttttaacccttttcccatccttttcctcttgctgctgtgatacaggaagaaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacatattcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaactcctgggctcaagcaatccacacaccttggcctcccaaagtgttgggattacaggcatgagccactgcacccagcctatctcatcttttaaaaaaaacatatcaaataattgttcataaatcattttctgtagtagagagcaatttttcttaaaattggcaaataagattttgcatctacctttgagaaaattgtatttgtaaagtgattttaaaagaatgaagcctatgagtatgatggcattataaaagtatcagtggccaggcgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaagtattaatatatggaaatacaaatgtcatatatagatgtaaattctcctaattgttcttctgagcatcatgatttttttccatgaatttttattttaagttccagggtacatgcgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcatggggtgggcactgttatactccatcagtgagtacgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagtgatgaggataatgatcatagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgctcgtatagcaatcctcaaatctcagtagcatataaaggtaagcatttagttctcacttacaagtttgcagggcaggtgaggcagctctgcctcaagccacaatgtctaggacagctctgtttcgcactgtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacataccctcatgaggctgtggagagagtgtagattcagggagcggtgagaaactggggccagtacaccaacttacagcatgatttgtcatcatttttcattctctgctagtaagattgccaaagtctctctgcactcattgaattcatttagctctctttagctctctttttttagctctcatttagtttccatttagctctctttctctcttaccacaatacctaaaaatctttttatggggttacaactctgtctcaggagccacctcagtttggtggcacagagctccccacttgtactctgaaactcttttcttgaagatattgctatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagaaacttctggattcaaatgattgtttggaggcattagccaggcattgaaccaattataaagagtgaggttttgccatattctaaccgtaagaaacagaaacggtagagggtaaaaatagaatagaatgtcaatacaactttagccttttccctggattctgagagttcataacctgaaaatcagagattcaaactgggagagatgggctaacaggtatgagcatgggaaaagcatgtttcaagaatttgagatgtatttcccagaaaagcaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccatggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaaccacaaggtcttcctctgcgttctctcctttctggatgccagatgtgtgtgtgtcgatttatctgggtgcaggtctcagcactatgtacctaccaggtgaaactaaatcagtatactcaaaacatcacagcagggtccttaaactgtgtaccaacagtacctcagctaggccagctctaagtaggatgtctagagtaagacttaggccctaagattgtatcattattccaaatgtatgcctgtacatagtaaataataataattcaaacaaatgagcaataatgaacaatgaaatatcttcctcccacccaaaacctagatctgcagtcaccttccacagaaacaaaactgctaatatatatatacatattatgcatatatatgtatatattagcattattatatataaactatatatatatatatatatacacacatatatatagttttaaagctgtgggtggtagaacactttctaagtattgtcctatatcttacttttatcacttaaaataccttaaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataaatggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttcgttaaaaatgataatgcaaaagtcaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttcgttttttttttttttttttttttttttgagacagagtctcactccgttgcccaggctggaatgcagtggtgtgatcttggctcactgcaacctctgacagagctgtttcaacaagatactttgggtaattcaagcagaagtgtttcatggttcaagtgacaacaaaaggactagggctgggaagagtccattttctttacctctacacagactctaggacactcagcatcagtgacttactgagaatcatatcttttttatattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatctgatggaggtatgttacaatttcccactcttttggatatacaaatgcaaattaagcatttccctaatgactatgatattgaccatttttcacgtttattacctatttgggtatccttttttgtaaggtctttttgataatttttctattgtctgtctttttcttactgacttacaggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggagggggaaaaggcactattgtctcttttccgccttagtctcctaagaaccccatttttacttagccaaaccaactgcctctggagaaaagaaaagtagttgaagcatttttggttatgtgtagaggtgtatgtcgaaaggaaaagcccattgacttggagcttgttttgctagtgatatcattgatcttacatatgtgagtattcatatcaatgtagtaggatgtttatatctggatgtttgcccttctgtgtgtttgtcttaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctttttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcatggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttggcagagctctgaggctggatgttgcaaggagaaaaaataggaagcccacagggccaagcttgggcctccttgtacctcctccactgtatacatacattttgggttcatatttttcaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaacccccatcaacaatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaagaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcaggagaatagcatgaacccgggaagcggagcttgcagtgagctgagatagcgccactgcactccagcctgggcaacagagcgagactacgtctcaaataataataataataataataataatgatgataataaagtcactgaaatggcaagtgtgtgagtcagggttcactcctagttgaccactgccaaaagggcatggttactgaccagatgacacggtcattcagggaaggatggaccttgtagagcaggggttcccaacccttactggtccgtggcctgttaggaactgggctgcacagcaggaggtgagcttcttcatgagccagcattacggcctgagctcctcctcctgtccaatcagtggcaacattagattctcacagaaacatgaaccctattgtgaattgtgcgtgcctgatgatctgaggtggaacagttaccttccaaaactgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaagggttaatgccttatggatgcattttctagggccaggtttcccaagggggtaaagggcatgtcttttgtgaaaaggacctggatgctaaacaggcaaccttgtcccccatcaactttctccttagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttctttttttctccttcattttattttcccctccctcccactcttccctccactccatgacccccccttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctctagaacaaagtctccttgggggggaaaaaagttcatcttcaacccaaattcatttcaagtattaaatggcacagagatatcagttgtctctggaactagggagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagctagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggcgccacactgtggccgcatgtgcatattgcagcctccgcctgtatctgggggccgcagccgccagcgcccggggacccagctgcggcgaaagctgttgggcgcgcgcttctccgcagctccgcgcccccgccaaaacccagtgagaaattatttgcattcctggaggctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgccagctcccgggccccggcgcggcgccacctggcggccgtctgtggaggttgcagctgccgccaagccccggggatgctgccggcctcaggtgcgcccggccgagcctccgcggagaggaggattggtagatcacaggaaacgggaggacggcgctgggctcccagcaggcgccccattttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgaggccctggagggatctgatgcagctggcggggagaaaggtgggtcggacttagaggggtggtggggtggaggaatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttaggggtcgttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaagagttgggtccattctggatctttcctagctaaatgccttcaggatttaggaatattttcctaggagggccaaggattagctagacctgcccagcgattccagccctgagaaccagacagaatggaggtatagctgacagctggctgggagggggctgacggtcctcactgccaccaggcttagttggagacagattcctcgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgagacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggactgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaataaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccatgcgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacaaataaaattgcttgctgtccttctctctttattctccacttcttgttttttctaaatgtggggtcaaaacttccatgagggtaagaagttcagttttctgcctttccccttcatctccctatcacacatgtatactactcaacacttagagaagattaaaaaaagaataaattgtggagagggagcatatgtgaaagtaaaagattcccagacataatatgggagttaatggagaaagaaaatctctaaggaagactagaaataattgggttagggattctcgagaagtaaattaaattccccaaatgtggtattctctgagaagataattttgaagaagcaatggcgtgatatccagtgaaacagcagtcctctggagcctggctgtgacttcaaggcccagttcttctggaagggcagaaaaatacttcgaagaggagaaatgagcatttatataggtttataagtaccatctttattttagaaaataatcattttctaccttgaattctagtttattgtgaccaaagattgtaaaatttcaggatatggctgaattaaaatcttggtcctgcacttaagtagctccttgaattgcaatttcttatcccaattattttatcctttcattccactgtgaaatctatatcatggcacttaatagtcaactttattattttaacaaatgcttatttacctttcatgggttatttcatttagccttcataatatctgttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcagtggcactatctcagctaactgcaacctccatctcccaggttcaagtgattctcctgcctcagcctcccaagtagctggaattataggcacacgccaccacacccggctaatttttgtatttttagtagagacgaggtttcaccatcttggctaggctggtctcaaactcttgacttcaaataattcacccacctcgccctcccaaagtgctgggattacaggcatgagctgccgcacctggccttggtgctatttttaaggatatgtatatctgattttttttctgtttctcttattctttaattctgttaattctttattcaggtattttacttttcttagctcaactttggtaatttgtatggaaaagtcaacattttgtctacattcgcaaatatatatcaaaaatacacatcattttaatatcttctatatctagtattacttatgtgctttttcaatagtaagtttacggaaggattaactcttaattttcttttcagggaacacggtgtttggttttataaattccattttggtggaataggaaggtatgatctgtttcattgactatgctttcatcttactttatgccttctactttccacaggtttttgttgtgttcctttgttagcgtttgagttaaaaacttaattctctctctgttgctcaggctggagtgcagtggcatgatctcaactcactgtaaccctccgcctcccaggctcaacgatcctcctgcctcggcctccctagcagttcgaactataggcgtgcaccacgacatccagctaatttttgtatctgttggagacacagggtcctgccatgttgtccaggctggtctccaattccagaggcaataattgggaggccaaggcgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagtgtataatttttattctgatatcccctttaacccatgtgctttttcctaagagtacaacttaaggagggcatgtttgattattttattgttttataatcagttaactatgccctggtcctatatggtttcagcttttcagcacttgttgagacttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcagtaagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgactttaaaaaaaaaaaaaaaagaggaacttgctctgtcaccaggccagagtgcaaaggtgcaatcatagctcactgcagccttgacctcctaggctcaagcaatcctcctgcttcagcctcctaagtagctgggactacaggtgcatgtaaccatgcctggctaatatttttactttttgtagagacaggggtcttgctttgttgcccaggctgatcttgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatgtgtttagaaatttctctttgttcccaaattttgtcactgtgaatctaggtgagggtccttctcatcatgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatttgtattttatttcttacatgttttcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggacggagaaactcaaactatgtgtttcctgtgctttcacactacaacaatcaacacagaagactgacggcggaggggggttctccatacagcaagcaagcaatcagttctgcagtggacaccagctgagtgtactccaattcaatttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggtaaagtatgggggaaggagcatggagcttccatgcacctccactgggtgcgccgcccttcaggaacctctacatgttcagctatccagaagctctccaagccctgtccttttgggtctttgtatggaggctccattgcataagaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagaccagcctgggcaaaatggtgaaaccccatctctataaaaaatacaaaaattagttggttgcggtggtacatgcctgtggtcccaactactagggaggctgaggtgggaggagagcttgagcccaggaggttggggctgcagtgagttgagatcgtgccactgcactccagcatgggtaatagagtgagacccggtctctagaaaataaataaaaagacttcagtcaccaaggtaaggagatgggtggatattcctactgtggtacctgaactgtcatcctgtcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagatgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcataggttatttcctcatgccaggaagaacagtcacagttctgtttcattacgcttctatctttgagactcaaattcccccctccccactataaattatttgcacatactagtctagaaaaatttaatatgccactttcccccacaaacacatctccacaatcataaacaccatgaaataaacttctcttagacaaatgaaaaagtttcttacctttttctccaggctaaggatcaaaattcaagttttacttggttaactctcctgctaatctgaaaactgtcttctactctatagatgcttgctgtttcaggggggcaggcgggagttatttaagaataatttccattacctaataccttgatactaatgtgaaaaaaattatgaaaatcagaggtcaaacacttaaaaagatccatgaaaaatctcctacaaagacacttaaataagtaaaatcatcaaattttcataatgtgacagggagaagattgaagaaaccaaaaaaagcaagtatgttcctttgctggaactaatcctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagagttctccagagggacaaaactaataggggagacatatatctatagatatagatagatgataatagattagatacagatatattaaaaggagtttatgaaggagaattggctcacatgattacaaggcaaagtcctacagtgggccgtctgcaagctgaggaagaaagaagccagtagtggttcagtctgagtccaaaagcctcaagagtagggaagcccacagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccaccttctctctcctgctttgttgtagctaccctggcagccgactggatggtgccaacccacattgagggtgagtcttcctctcctagtccactgactcaaatgttaatctcctctggtaacaccctcacagacacacccagaaacaatacttagctatctaggcatcctttaatcctatcaagttgacacctaatattaaccatcacaccctaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggtaatttgcagttattgtcctttgatcatgtaaagcaactgagatcatttgctcctgacctcacgtcactaatctatatccttcattttttgctccaagtgttccttcttctgagtgcctagtgctgctccagtacctagatatctctctctccccctctctttctgtctcaatatccaatcaatcccaagctgtattagctctttaccaactttgggaaagtggaccagtatccaggcttggataaaccaaggaaaaatactaaggaactgcttaaagctctagtggttcttctactttgctgtttctggctttggccatctaaagcaaagttccttggattggttgacagtgagatagtctctagattcttgtgtctctttttagtaggaccacctaagatgtatcatccattgtataatgagttcttgaccaaagaaaagaaatcttaaggtcttcggactctgtcatctttcttgtttgccactctttggactgtaatttgaagagaaaaaaccttgttttcttgtgaaaattttggatgctgagtagttgacaacaacagtaacttcagctagaaaatgctggaaacaatttaataagcagaaatgattaaatccaaaatcatcaacatgactccaccaaccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtctcatttcctaatttattattttcctaatgggccacatagcagacactgaaggttctacataacaaaggtcctacaagtaaattgtgaaaatcccttattggatggtgtttttagaatacagaaggtcttatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacaacactgatcaaatatttaccatgttccagccactgtactaagtgctttgggtacattacctcatttaatcttcatatcaagcctagaaggtagtttccattatgttttccactttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagccttcagcatgatatgtgatcatgtgagagccacgttatgtgtattctttttaccacctcttctgtatccatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtcttatagtgttccataaagtgatgggactataattgtccatcttcaagtatccttctatgactcatgtataatcccttgacttttaggagattcctggcagttaatgtcaatactgcccttcataatgcttctgagttagcttaggtaaggtccttaaatacccaatgacttatactctgaggcttctaaactggtatgtggacctcggtggttgcaacttcacccaaatcctcattctgtgttgtgctgtccctaatttagagggcaaaagatttcaaactcaatcatttcttgttaaattcaactcttggagctccacctgtcataaacacaatcccatttcccatgtactcagttacttctgtttcttgaatccatcattcatcccatagatattgagtgcctaatgtattccagatatagttctacataatagggatagagcggtgtatgaaacaaagcacctaccttcataggacttattctgaggaggtaggaggggagacaaatgatataataacttggactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggcaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaatacattagtattcagatggtatatggagaataattaagaaagttatgagaggccgggcgcactggctcacacctataatcccagcactttgggaggccgaggtgggtggatcacaaggtcaggagatcgagaccatcctaacacagtgaaaccccgtctctactaaaaatacaaaaaattagctgggtatggtggcacttgcctgtagtcccagctactcgggaggctgaagcaggagaatcgcttgaacccaggaggtggaggttgcagtgagccgagattgcaccactgcactccagcctggacaacagagcgagacgcgagactccgtctcaaaaaaaaaaaaagttatgagataaggaataccaagaagtgaggaaagaaaaggaggggagcttgttatcttacctaagatgttcagggaagacctcaatgacagttggtaaagtaacttctgagcaaaagcttacaagaaattaggaagccagtcatgcaagtatctagggatgagcctttgagaaaaggaaatagcaagtgcaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggaaggagagagcagaatcaaggaggccatttaaaatgccattgcaaatatccaagagaggtggaagcttggagcagggaaacagtggtggaggtggtgagatgtggttggatgctggacatattttgagccaagaggattgtctgataaattgcgtttggaaaataagaaaaagcttattcactcaccagcctaatagtcacaccaatctataatcccagcactttgggaagccaaggcaggtggatcacttgaatccaggagttcaagaccaacctgagcaacatagtgagaccccatctctacaaaaacaaaaactctaaaaattagccaagcatgtggcatgcacctgtagtcccagctactcaggaagctgaggtgggatgatcacttgagcctgggaggtcaaggctgcaatgaactgtaatcatgccactgcactccagactgggtgacagagcaagaccctgtctgggaaaagaaaaaggcatggcggggggggggggggcgggcatggtggtacacacctgtaatcccagcactttgggaggctgaggcaggcagatcacctgaggttgggagttcgagaccagcctggccaacatggtgaaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagattccatctcgaaagaaagaagaaagaaagagagagagagagagaaagagagaaaagaaagaataatcacaccccaagaaaatcaagctaggaccatggtgagcaatgctccaagagtgttctgatgctgtaaactgagtatgatgtgcataaattgttttgcactctgcaggtaggagggtgggatagccaaagctgttcaatataataatattaaaaaataaaatctcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttttcaaaataaaatggattaacataaaaaattattaaagagataaactaaaggaaaatattacaacctggctgaggggcaaaaattttatgttcaacatatatttgataatacatactgagaaaacacggtctacttttacttttcaaaagtttgttcatgttgacattgtggggcctagaagatttttatcaagttttctatttttgccaagtcatatgatctgctatagttcagctatagttaatcaaatgtagaaaagaaaaaaattttccataatatctagtaattctccaaaacaagcttgttcctagttaaacactgacattctttggtaactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttaaaaagctacacaattattcgttatgcaaggaatgaggccttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaaaatgctttacatgacagtagaacatttaggctaagctggaggactggggagaacaagtgaagaaggtaagttttggctagataataggtggcctttagtgtcaggatgaggatttggaagttaatcttttggtcagtggataataaatgatggcatttgtgtagttgagccagttgacaatgctttaacaacttcaaaaggccctgaaaaacatggtccctaatccttaagaaaaaaggaactcctgacttcaggaccctaagctaggaggaaattggataaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaaaaaaatcatgtataccgcattttatatcttttaattgggtgtaaatttgaatttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcaggacatctgtgacacaaagactgtgacacacccacaggtcgattaacatgaggacccaacacctattaaaacatccacactcctgagaacactaaaaaccaaccacctcgtcaggtcccacctccagtctagctgaatcaggaaacctcaggagaagcacctggaagcaggtttaacaagcgcaaaggtgactcttataattgggaaagtttggaaccaagacagggttcttgtcctggaggaagtattttcctgtggagaaggacctgtaaacagcctatgaagtgctcagctttcaccaagaaaagaaaaacatgggctgatagggttaaggaaacgtttgactgaagaggattaaatcctgaaggttagggatgtctttgggcgctggggtctctcaatcaccaaagatcgacattacaggccaggtagctctttgtccccccagaggactgtcctgtgccttatgcttagcactcctggcctctgcccattggatacttctagcacctcccccgcaacacacacacacctgacaacccaaaacatctacagatattgccaaatactccacagggggtggggtggtggcaatatatctccctgtttgaagtcactggaatggaagttaggggaggatggctaagtcaggacttgcaaaaaggctaagggacgaaagcacatggctatattagacaaagtttgtgacagacgcctgtaggtatatggtaaggaaaacagattaaaacactaagaaatagtaagaggtcggaccgagggtttctcatctgtatgggaaatctcatctcgttcattactttcagaaacaaaaaggaaaacgactttaaagatacaggttaaaggccgaaggggtgtagaaccaccccccgcctccttccctccatccctcccaaatatcccagaacgagtcaaacctttcgaatctcgtagcacagataacaagcaactcagtaagactggacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggacgcctctcccgcgatgcgctcgaagatgtcgttgacgaaggagttcatgatgcccatggccttggacgagatgccggtgtcggggtggacctgcttcagcaccttgtacacgtaaacggagtagctctccttgcggctgcgcttgcgcttcttgccgtccttcttctgcactttcgtaacagcctttttggagcccttcttgggagcaggagcggatttcgctggatccggcatttttgcgcgaaaaaagagaaaagagacttaaagaagtaatccgaactaccgcaaaacgggctggttatgcgctacttatagagcccgtatgcaaatgaagactcgcaaagtgctgcgctttcattggttaacttacaacggtgtcgtcagagggggtggagtctatgtaaataatagattctagtcttgcttccttaatggtcactgtaacaaaagtcttgttatcctatcagaatggtccatttcacactaaccagttttaagctaggtgaagcgatagtttctacggcttggggttttttcttggttttcactttccattagacttgcatacggaagaaatcttaacgccagctagacaagttaactctcttgcctcgtttttgcatttttattctatactttgtggaaatttttttctcttccttgaaatactacctcacccatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaacgctcggccggaaccacaaggaccatgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatatgccttaggcccgctccccgcggatgcggcgggccaactggatgtccttgggcatgatggtcacgcgcttggcatggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtagacttctggtagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgataggagagggtctaggcagtcatatttatagacatagtctcctcttgattgggcctgaaaaggaaattttcaaacttgtgatctcattggttaaaattcaatcctctttactggggcggaagattgttctgctaatctttcttcccttattatttccccctttcctgatttttttctgtaattttatcgatcacggattgtttttgaagactttcctttaaattagtctaacttttgtaaaagcaatgtataaagtgttttgcatcccattttaacagagattttttttttccccgaattcaagcatgcccttctatgagctatcagcctgtttcaggttacctgttactgtagctcttctaccatagctaacatttatttcatgtctggcattttgctcagcaagttagatgcattgtataccatgaatgaccgaagcttagcaaaaaaatatgtaattgaaggaatgaaaaaattgatcttatttacttgaccttggaacccagccaaagccatttcatgtgggtagtgtgctgacctatattgacctgatattagagcctctgccttcctttagtcttttctccctgcgatgtggttccttcttcctcaacctcacatcaatggccaattaggtcctgcagatgttaagcttctaaatcaaagaaggacaacaccagaaattcatttctcctttacaatgtagaatagtttgtaaattagtgcttattagccagattacaagttcaagtttcaaagcaaattattcatcaattgctgacttgctaacattttattcaataaagtattttataatgcttaaaagtttagttttttttctgttctctatgaagagagtaaagatgctttgctttttcaatttcatgtgctttgaagtatgtattgttcagaacagtaaatatcatagtggttatgtagaagcaactgatacttaaaagttgtagtagttaatataaaacttttaatcatatccttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatgttactcttctcactttacagataagaaaactgagtctcagagaaattatggcttgtcctgggtaagtaacaaagcctgtgtaatattctaaagcaaaagaatgaaactgtaatgatgaaactttctatttcattaggcttagaggatacctttttttttttttttcatttgagatggagtctcactctgtcacccaggctggagtgcagtggtaggatctctgctcactgcagcctctgcctcctgtgttcaagcaattctcctgtctcagcctcctgagcagctgggactataggcgcaagccaccacccccagctaatttatttatttatttgtatttttagtagagacacggtttcaccatattggtcaggctggtctcgaactcctgacctcaggtgatccaccctcctcggcctcccaaagtgcttgggttgcaggcatgagccccacgcacccagccaacacagtttaaagcacaaaagcgttttcccatcaagcaatcacatcatctagtatttctcaaacatctacacccaactattcccattagaagggaaaactaccccatggaatctggatgatagcccaaagcagcccacccaagcatcacatttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcaactttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagaaggcaaaagaaaatattaataaatgaattattacgcacataatgttttgtatgtacatgtgtttacttttaatacaaaagtaacggactaagttaacatagatgttccaataagataatttatgtttcatttttggcttcaagtatcctcagggttataagtatcataagctgagaccagctgaattggtttgtgggttgatgaggccctatgcctgatttgaatttctcttgaatggtctgcagccctggaccaagttgaagaagccatgagagtctcagcttttttccttaccccattatgagataaactcattccttaaatatcttgctcatttgataaaacttggcacctttctcctttctactggtccctaatacttactacctgtactgtaagctcaaattttttgcaatttctgcctttattatgtaacgtattccactggaatatgtgttacaggaaaggggtcccgatccagacccctagagagggttcttggatatccagcaagaaggaattcagggccagtccataaagtgaaaacaagtttactaggaaagtagaggaataaaagaatggctactccatagagagaacagccctgagggctgctggttgcccatttttatggttatttcttgattatatgttaaacaggggtgggggggtggaccacgcctataatcccagctactccagaggctgagacaagatcatttgaaccccggaggcagaggttgcagtaagctgacatcgctccactgcactccagcctggaccacccagggataatccgtcccccgcaccccgcccccccaaaaaaatcactgccagtaaggaacaaacagccaggacgaagtactaagatgtaaagagatgtaaaatagcccgggcgcggtggctcacgcctgtaatcccagctctttgggaggcctaggcgggcagatcacgaggtcagaagatagagacgatcctggctaacacggtgaaaccccgtctccactgaaaatatttttttaaaaaaaattagccaggcgtggtggagggcgcctgtagtcccagctaatcgggaggctgaggcaggagaatggcattaacctgggaggcggagcttcaagtgaacccagatcgcgccacggcactccagcctgggtgacagtacgagactgtgcctccaaaaaaaaaaaaaaaaaaagaaagatgtaaaataatgtgatacattctgcaagagttatgacagagtcagaaaggggcaagcatgtttcttctctaccctgaagcagccaagggagaagaagatatctgttgccaacgctggggtgttacaagtgcacactgccatgcccggctaattttttggattttagtagagacaaggtttcactgtgttgcccaggctggtctcgaactcctgagctcaggcaatccacccgcctaggcctcacaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtgtaagtatgtccatttacagattgggagatggaggaatcacagagcggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgtgcgcctgtagtctgagctacttgggaggctgaggtgggaggatcgcttgagcctgggagattgaggctgcagtctgcagtgagttatgatcacaccactgcactccagcctgggcaacagagaccctgtcttaaaaacaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacgaggaaaattagagttatcaatgattttgggggatgagtggagtgtagttttcataggctcaaagcaaagcagggctgtgtgaaagggtaggcataggatgggactttgcagtggatccagggtcttgtttcctcagaaactacaacgttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggagaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttatttcccccccctttaatctatattttattttatttattttttacttttttgagacggactctcgctctgtccccagggtggagtgcagtggtgcgatctcagctcactgcaacctctgtctcctgggttcaagcgattctcctgcctcattctcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggtcttcccaagtgctgggattacaggcatgagacaccgcgcctggcctaatctatattttaaaaattgaactcttccatgtacccctgaacctaaaataaaagttaaaaacaaacaaacatacaaaacaacaacaacgacaaaaaaaaaaaaaaaaaaaaaaccaggccgggcatcgtggctcacgcttgtaatcccagcactttggaaggccgaggcgcgcagatcacgaggtcaggagttcgagaccagcttgactaacatggtgaaaccccgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaaaaaaaaagagagagaattctgtactttgtaattagaggggtaattcattaattcatgtcaggggcatattattttatttttccaaatgctaggaagcaggtatccattttttgataatataaattttgggataattggcagtcatctggctcacagggaaaacaggaaaaacaagaaacctaaataaacttcatattgatttcccaaaaaaattaccttttattttcaacccttatagaactcaacctgcatctctttgccatccatgttctttttttttagagactgggcctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccgcattttatctccccactttcccagcaatggacaactaggcttgtgccaattctccatcaccaccagaaatgctgcaatgaacattgttgtatatattcccttttggacctatataagaatttcttttggataaaaactcaggaacagaagtgctgagaagccagaaaccagcagttctgttcagagttttatttacatctaattgaactaaggagtgtcaggctcccctccagaatgcttgtcccggacttccaataccaaggtagctggactctgagcccacatccaggcccagtcctcgggtcatccaactttctaagttttgccagactgcctggtgtaaagtggtatctcagcattgctttcgttttcattgttccgggtattcatgagttcaagcatctctacctgagcttgatagttttcggatttcttctcctgtgtattgcctgttcatatcctttgctccaacattgtttatagagcactccctccctactttggcatttggggtcccctaaactggcccccattgctaaagcttacttctcatgactgacctttgcccatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattttttatttatttatttattatttttttgagacgaagtcttgctcttgtccccgaggctggagtgcaatggcacgatcttggctcactgcaaactccgcctcccgggttcaagtgattctcctgcctcagcctcctgagtagctgggattacaggtgcctgccaccatgcccgactactttttgtatttttagtagagacggggtttcaccatgttggccagactggtctcaaactcctgacctcaggggatccgcccccctcggcctcccgaagtgctgggattacaggcgtgagcgaccgcgccaggcctcaacctacatttcaagtcaccatctgtcacaggataccttccactctggctctggatatgggggtcacctcctcacaaagacagacaggctgtatgtgcatacacagaaagattcagaagaaacatgaagacttttaaaatcagtgagatgattttaactttctttaaatcagtgagatgattttaactttcttctttgtagttttctctagccagttttaaaaactgtaagttgtaggccgggcgcggtcactcacacctgtaatcccagcactttgggaggctgaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgaggcaggagaatcccttgaacccagaaggcagagcttgcagtgagctgagattgcgccactgcactccagcctgggcgatagagcgagactccatctcaaaaaaaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgttgttgagacggagtctcactctgtcgcccaggctggagtgcagtggcagatcttggctcactgcaagctccgcctcccgggttcacgccattctcctgcctcagcctcccgagtagctgggactacaggcgcccgccacccatgcctggctacttttttttaattttttttttttttttgtatttttagtagagacgggttttcaccgtgttaaccaggatggtctcgatctcctgacctcgtgatccgcccgcctcggcctcccaaaatgctgggattataggcgtgagccccagcgcccggccaatgtaaatgtatttcttactgtagacttgaggtcaggagagtgggctgtactggacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaacatagggaaaaagccttttcttctttccagggttgttgtggactcaaacgagaggctgttagtgaaaggtttttgtgagttatgaagctcctaggaacccaattatttctgctgccttggccacatagtctagaagaatctctacataattagcatctagagactagataatttacccattattttccatgtgcttgtcttatttcccagcatgacggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgtccaaccattcaggcttttcattattataggaagcatctggccaaggaccaccaccatcttcctgtcctgcccctgaagctgtgagttccccaagtggagacacagcctgttccccaacacctacactcatgaacatgggagggttggtcaaaattgcacagctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaactaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctccctttttttttttttttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgccggctaatttttgtatttttagtagagacggggtttcaccatgttggttaggctggtctcaaactcctgacctcaagtgatccagccgcctcggcctcccaaattgccgggattacaggcatgagccgccgcgcctggccttgctttttctcttttaaaattactgttactcatggggtatctgcaggcctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattagggatgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtccacttgcaaagacgacagatctctctacaaattctgggctgagcaggtgaaggaggctggtcaggcccatgaaggagcctagtcagccgtaaggaaaggttcactgtggggcccccgactttccattcctgatctcctttttacctctgctgcccacttcctttcctctttccctccaagtataccttatactctgctcctgatgacactcagatctccccccgcccccccgcccccatcaaatataaagagcctagtgacttttgtaagaacggtgtattcatttcctagtgttgcattaataagttaccataaacttagtggtttaaaacaacacaaatttgccgggtgtggtggctcacgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactccgtctcaaaaaaaaaaaaaaaaaaacatgaaaccaaacaaaacgaaaaaaaccacacagatttattctcttaccattctggaggtcagaagcccaaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagattccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccctcttctcgggccaacctggaggaagttccttccagagtccaggctatacttgcttctggcctgcaaattcccgagaattctttgaaacctaggaggggcctgggtattatgccgttttgagtgagaattcagaggccagtggaattagggcaatcaggcatttcctgatcatctgctatgctccaggatgctgacttgaagagatgaacaaggcaaaatgcccattctgacggcactcagaatttcacggggaactggaaggataaatgaatctgggaggaactgctaaaacaggtaggagagggtaagcttgttagaacctgagaagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcccagtctgtaaagtgagaatgataaaacatctgccttccttgcaggattgttgtggtgatgtgtaagacaaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatcagagtaataacaactggtggatgtgttctcctaggtagagaacaggaatctcaatttttaatgttgggagggactttatgcatctttttgctttcaaaagcaatttctggctgggcgtggtggctgatgcctgtaatcccagcactttgggaggccgaggtgggtgaataacttgaagtcaggagttcgagaccagcccagccaacacggtgaaaccccgtctctactaaaaatacaaaaaattagctgggtgtggtggcaggcgcctatgatcccagctacttgggaggctgaggcaggagaatcgcttgaacccgagaggcggaggttgcagtgagcagagatctcgccactgcactccagcctgggcaaccgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaattttttctttctttctttctttctttctttctttctttctttctttctttcttctttcttttttttttttttttttttgatacggagtcttgctctgttgcctaggctggagtgcagtggtgcgatctcagctcactgcaagcaccgcctcccgggttcacgccattctcctgcctcagcctcctgagtagctgggactacaggcacccgccaccacgtccggctaattttttgtatatgtagtagagacggggtttcaccgtgttagccaggatggtctcgatctcctgacctcgtgatctacccgcgttggcttcccaaagtgctgggattacaggtgtcagccaccacgcccggtcaatttttgtatttttagcagagaggaggtttcactgtgttggccaggctggtctcgaactcctgacttcatgtgatcggcccaccttggcctcacaaagtgctgagattacaggcatgagccatcacgccccgccctaaaacaccaaatcttattaaatctatattctacaactctgtcacatccatcacttcatctctgcccactcctagcactgacttagctgaggacatcatcaattctgatcaaaggaccctaagtctaagtaacaataccactttcatggtaggctttccccggaaccagctggacataatgagaattttcaagagaatgtgaattgctctttacttgattttctttttttttgagatggagtatcgcttttgtcgcccaggctggagtgcaatggtgcgatgtcagctcactgcaacctccacctcccgggttcaagcgattctcctgtcagcttagcctcctgggtaggtgggattacaggcgcccgccaccaagcccggctaatttttttttttttttttttgtatttttagtagagatggggtttcaccatgttggtcaggctggtctggaactcctgacctcaggtgatccgtccgcctcggcctcccaaagtgccgggatttcaggcacgagccaccgttcccggcgattttcttttctttaagactaatctgaaagtgcggaactctgtgtacctgaaatgattacattttgatattgacatgaaaaaattgggtactactttgccccagtttctcaacccaacaaagacattccaaaagtttcctatggggcctaggaaggttggccttcacaggatagtggcaggagtgttaactttgtcctattaccaaaaggtgtcaaagctgttactaaattgtctgtgtcagtatcggaaaccccgacagcactggagaattcctcatggtccttccagaccatggtcacagtgagaagcagattctgttgccctggccctgtggggaaatccccaagatggctgctgatagttaaggaaacagtgtcctgccatggcctgaccctaggctgggtgagagagagtgggtcagacaggctgcacttcctcagtgagtgtgcatacacctgttcgcactgcctatcgtttcctcacccagtgtgagagcagggggctcagttgggctgagtggagaattcatgggacctttccatggtcaaggcccagagcttctattgtgtagcatccctggaacagagaacaggaggcagtcacaaggccccagcttcaacctttgacagtacaccagaaaagaccaagtagtgaggcctccactgtctcacaccagccaagaaagaccaggtcttagactatccagtgttcctgcctctctttcacggtgctgtatctggggaatgaatactccattgtcataggaggggcagatgcgggcggaagactcagaagggtcaaggtaggacatagacattcccactaagctagagacccctgaactgccatagccatgacatgcacacgttgtcctcaaatcccagggccatgggcaggtcttggatatctttggaattttaagttggttggcatctgtctagttttaaacctgatttaggttcagttcaaccagggagtatgattctttggggagagggccctgacctagaaatctacatgctcagcggtctgctcagccactaatggctctgacacactggaaaggcactcaccctctgggagtttcagactgtatctttgaaaacaaaattcagtggatggggtgcaaaggtattgtcctcaacagctctaagttactacttctaactcacagagcacatatcacaaaggatcccactatccattgtcggtctgagcagggaatgagactttggcagaccatgaatcctgtattaatttctagggggactataacaaaataccacagacttgggggtttaaactgagattgcaccactgcactccagcctgggtgacagagtaagaccctgagtcaaacaaaaaaaaaaaaagtgtatacatgggagcactctgtgatgagtaactcaaaggagtggttagaatttgggatctacctagcagcaggggaaaaggaggaggagtaaaggacatatggaaaaccaaatgacttttgaaaagataaatgggcccttagaatagatggaagattcgagtcttgtgacaatgtctatttgggtgtggtgaccacttctcatctccgaggttagatttgcttctagtgctgaagaagatttatgacaactgagttaaaaatttgagatttgcgaggaggatctgctattaaacaggtaagggattttagctgtttgtttcagctgaaaataattcttaagtcgaaactggcacatttggaggtagcatgtcctgatccccttaaaaagggaactgcacagacaccgtatctctgattctgcccagggtcctgtgccctctgacaccagaaatcaccacttctctcagccttgttttgcggttgttttatcatgttgcaatttggttatgtcttttctaatagtgtttaaaagcaatcaaaggcaggaacttttccttttataaactattgttgagcttatattggacactgaactaagtgtcagtttacaaaaatgaataaacaaaaatcactgccagtagggaacacacagccaagatgggggagtagtaagatgtaaagagatgtaaaataatgtgatagattcggccagagttactaaagagtcagaaaagggcaagcatgtttcttccctgtcctgaagcagccaagggagaggaagatatctgttgccaatgctggggtgttggtttaggcatgtagatgctgtgatgcgcagtggaaccgttcaatgagcagacaggagaaccagctttatgcggggagggagagaattgctcccctcatcccccgtgagtcacaccctggagattataagtttaaacattttgatttcgggagattttgagttttgggcttaaaatgactgaagaaccaccaggtggatctacgtgtctcgagtccagaagtctgaatacagatttacgatttatgagcacacagaaggtggatccaagggagagattaaacagggcacagaagagtttttaaaaataatatttttcgggaaaaaaaccccaacaaaacacgattctttcagcagaaaccagaagattttctcatagactctcctacagagagccctgataaagtaataaacatgctaacagtaagaaccccaaccaatttcatagggcagtttgcggtaactactcccagtatggagcagacagtcctcttgcaaaacccgatttagcaaactttgctagctccatgtggggcctccaaaggacacagctgggcactaaatcctggctgaaaacaaaggccgatttagaggatccgtagaaacggatgcacagaatatccctcagtcttctctatgtagcaggccctccatatacgcgggttccccaagaccgaaaatattaaacaaatgaatttcttttttaaaaaaaagtacaacaaaagatagtaaaaataaaaacagtataacaattacttacatagcatttacactggattaggtgttacgaagtaatttagagactatttaaagtacacgggaggatgtgcatagttatgtgcaaatactacgccactttctatgagagacttgagcaacctggattttggtatcggcgggggccctggaccaatcccctctcagttctaccgagggagaactgttttgtttcttccagcacggctttgaccgacagtgtgttgggattcgctgacgtccatgagaaagcttggcagcatgctgagaccaattttcccagggccagaattctcctgtgtgagctaaaatacagtggctcggtccaacaaaacagagcctggagccaggaattatggcgaacctgctccctcccgtcctcccttggcgcacagatccctggcgccgccgctcttgaggtcgcctctcgcgtgtcgacctcatcgtcggaacggcgcttcctgaagctttatataagcacggctctgaatccgctcgtcgggattaaatcctgcgctggcgcgctcctgccagtctctggcctccatttgctcttcctgaggctccctccagagacctttcccttagcctcagtgcaatgccttccgggcgtcctcagaccagacacaggccaaagccactacagaatccggaagccccggttgggatctgaattctcccggggactgtggcgtagcggttaaaaaaaaaaaagagtgagagggacctgagcagagtggaggaggagggagaggaaaacagaaaagaaatgacgaaatgtcgagagggcggggacaattgagaacgcttcccgccggcgcgctttcggttttcaatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggtatgtgacttctacctcttagggcctgttgtagcttagaatgagagacctgcagaaacatgcccaccatcaatacagaaagcacaatttaattttgacaaggccaaaagccaattctgtatcagcatggcgtatattacagcaagctattctttacgctaccacctctaaattgccctaatttggattaaaatgtgggttcacatttctaatccttatagttttgcagccattgcattgcccgtaagattttttttttcttcattccaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtcctactgagatacatagtaaagggggcgagggcagggaggaagtggcaagaataacatttgtgaagatgtccaggtgagaaatagaggttttaatgctcaagatgtttccttttcccttttaaatctgacctgtgatttccagcattgctatttcgaatatcactgattgtttttaactttaaaggcaatgctgatgaatatatctgatccgcaccaagatccactaaagaaggagatcaaaaatttgaagataaagcagaaagggagtgggggagaaaacacgtccattgtctgaattagtggttctcaaagtgtagcctctcatctagcagcactgatcacctcggataaaatcttgggacccatgccagacctactgaatgagaaactgaggggtgagacatagtaatcggtgctttaaaaaagccctcccgatacacattaaaggttgaaagccactgatgcaggtaacagcttttctttttttcttttcttctttctttccctccctccctccctccctccctccctcccttccttccttcctttcttccttcccttccttcccttccttcctctttctttttttgagatggagtctcgatctgtcacacaggctggaatgcagtggcacgatcttggctcaccgcaatccccgcctcccgggttcaagtgattctcctgcctcagcctcccaggtagctgggactacaggtgcccaccaccatgccgggctaatttttgtatttttagtagagatggaggttttgccatgttggccaggctgatctcgaactcctggctttaggtgatccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctgaagtgcagtggcacagtcacagctcaccacagcctcgaacttctggcctcaagcaatcctcttgcctcagcctcctgagtcgctgggattacaggcatgagcaccgcaatttacagaaattgtcactttcatgatttccaacaaaacaacgagcaagttactcgttgttttacaaatgggaaaagttaaacctgttgagatttgcttcctgaagtcatgcacctgtttacatggacaaggctaggaatcaaacttgggtttgtctaactccagagtccttcctagtaattaacctccggtgctctgaactgccatgcaaaagaatgtgaacttcattctgaagggaatgggaaggtcgtggaaaatttttaagcatgaaagtgacaggctcaaaacagcaacaccaaccaaccaaccaaccaacaaaaaaccctcagtttttaaaagatagctcttggccgggcgcggtggctcacgcctgtaatcccaacgctttgggaggccgaggcgggcggatcacaaaatacaaaaaatacaaaactacaaaaaattagccggacgtggtggtgggcgcctatagtcccagctattccggaggctgaggcaggagaatcgcatgggcccggtaggccaaggttgcagtgagccgagctcgtgccactgcactccagcctgggcgacagagcgagactccgtctcataaaaaaaaaaaaaaaaaaaaagatagctgtcatacggagtggaagctcaatggcagggcagaaagaccagcctgactatgtaatctactagaccagagctggcgaggacttcagttaaggcatggtcatgggtggacggagaaaaggtgatacaattgaaagtcagaagacagatttagtaatatttggaactcatgagatttggacagaggacaagaggaagggacacccaaccagaacagatggggctaatgaaggtgtcttccaggaagatggggaatgtggaaagaaacaaatgggcttggaaagcaagatgaggcatgtggttttggaaataagctgggtttgaagtgcctagtatccatccagaaggacctgtctaccaggcagttagaaacattggtgtagccaggcacagtggctcacgtctataatcccagcactttgggaggccaaggtgggaggagggcttgagcccaggacttcaagaccagcctgggcgatgaagtgagaccctgactctacaaaaaataaaaaaaattagctgggcctggtggtgtgtgcccgtagtcccagctactcagatggctgaggtgggaggacccctgaacccaggagtccaaggttgcagtgagctttgattgtgctactgcactccagcctggacgagtgagaccctgtttctctttctctctctatctccctctctctctctctctctctctcacacacacacacacacacacacacacacacacacaaaatgtgtagagctcaggatagggtctcagcagaagatagcaatttgggagcgcttagctaagggacagaaatagtgaaagcaggcaatcaatctcacttgagttgcagggagaaaagaagatggccaaggccagcatgggggaaaccaggaatattgatggggaagagaaagacatgagaagactgagatggggacctagagaaggataagggtgaccaggagagtggacccaggggacaagtcctcttctaaggaagaaaaatcagtgtaaacgtggccatgtctcttaccacgtagtttccctctaaacacacacacacacacacacacacacacacacacacacacacacctgtcccccactagcctaaggcagaattaaatgtgaacaaagcacgtttttcacttcataaaagccacagattcagagtggacttactggcaaccaaggtagccacgtagaagctggttattagaggaagaggtgggttttcttcgagacagggtctcactccctgtcacccacactggagtgcagtggcacaatctcagctcacagcagcctccgcctcccggacttaagcgattctcccacctcagcctcccgagtagctgggaccacaggcaaatggcaccacccccggctaattttttcatttttctttctgtctttttttttttttttggtagagacacagggtctcgctatgtttcccaagctggtctggaactttgacttcaagcaatccgcccgacttggcctcccaaagtgctgggattaacagctgtgagccacaatgcctagtcagaggaagagtatttctttaccctatccttaattatcctttaactctcacctgagggtagacaatgatttaagtacagggaatgattaaatgttaaaacttaacattttagaatgttatcttgtattgatgaattcagcttatgctggtctcgcaaacaaatacgaagactgacagattcctgtgagtgcaggccttcacagtgccaggaccacaagatgtaatgaattctattcctgactggatataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtccccagcagagctcacctacgctgctctcctcgcttaacacgcctcaggaaaggcaaaatggcagctttacaaaacgaagttttattccatttccccttctcccctcttaattctcatagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactttcccactaagaggccttggacttcccagctcccagagactgtagagatcacctctgtggcctcctgtcacgatttcctaaggcgaagagcttcatttgcccaacggaggcccacgttcttcctgtctgatctactgtcttcccaaggatctgaactcgggcaccagcgtctgcccacatgtccgacgaaaacaacgtaaaggaactactgagtctggacagaaaatccagacataccatgcagcttctaagaggaccgagtgccttcactggaatagtgaatctccttctgtggacatggacagggaacggctcgataaagcccagattcacaaaattccgcccacaccccgtgcccccgggaattttggcttaggggcaggatatgggggttaccactgtgctagtggaggtggcgcggggactgaacggcagccccagcgcagttctccccacgtttgtccgcagaaccccggcgaggccgaggtggtcatttccctccctagccggatggccgcgccgggtgaggccggtttgggcgcgaagcacgggcgtgtggcgctccacttccgcaaaggccagccgcgctcaggaccgcgagccctgagcgtccccctagtgacccctggcctcgtgcccgacgccccgtctctcctgccccggcccccccgccacgcagggccccggtcacgcgcggggggagccggaccgccaaagcccgcgagccggcgcccaggaaagcgtccgcagcccggccagtgcggataggccaattggccgaagtcggcaaagctcaagacggcaccgcagcagggggacccgaccccgttttgttgggagcctaagcggaagtgccttccccgctctaatgccggaggagcacggagggcaagcggtacagcttcttccaagtgctgatgtgggtggctctgaaaagagccttttggatacgatggaacctccggccgaaccgccacttcttaagcccgctctccacggatgcggcgggccagctggatgtccttgggcataatggtcacgcgcttggcgtggatggcgcacaggttcgtgtcttcgaacagccccaccaggtaggcctcgctggcctcctgcagcgccatcacggccgagctctggaagcgcaggtccgtcttaaagtcctgcgcgatctcgcgtaccagccgctggaagggcagcttgcggatcagcagctccgtggacttctggtagcgccggatctcccgcagggctacggtgccgggccggtagcggtgcggcttcttcaccccgcccgtggccggcgcgctcttgcgggccgccttggtggccagctgcttcctcggggccttgccgccggtcgacttgcgagcagtctgcttagtacgggccatagcgaaccaaaacacaggcttaccagcgcagcggcggggagaaaaacgagctcctagccccgccgcagccgtctttataagcacagtcttttcccgattgggcggaacaataattgaaaatcccgcgctggctgtccattggctgtgacgtcacccgtcctaaagtcaccggttggcttgggcagattcctccctaatcccgcccaccccgcctcactttctacttaccagttggcgaagtttcgcaagcttgtttttcccctttccttcagggtgaaagtcattttccattgcagctttgtcagattgttccctttccgcccttcgcttccttagaacacactgcccgcaataccccccctttcttgctgcgccctacagctcccgcgtggaacctcattcttccatttgccccccgcccccagttgctacttggcggatcgtttttcgcctgtcgggtgccttttgggtgggagaggtgcccgcccccaggacgcaagattccgcctccgaggcccttactctccgccgccagggcgctttggaaaacaaaacagaaactaagacttaagtcagctcagtgaagccaagacccagctccgccacactagcgagcactacccgctcagggccctccccatcgggggtggggacgaggagcacgtcccgctggtgccagactaggtctaagtgtccggccatagcctgcggaaaccactagggaagcgcgcgctccgcgcgcaacacttcagcgcgttgggtactgcccgcggcgctggtgtttgtgactgtgtggagcggaccgtggcggcgcccaggacgtttggtgcctgcacctgccctgggaagtcctaggactggggacccactcatcgaagagccaaggcagttacgtgctccagatggaagacggcgcgcacacacacacaccccgccccgccccgccccgtcccgtcccgtcccgtcccgtcccgtcagctccaggttcgctattcactactgaggaacgctggactgagagtggccagcattaacaactcttttatttgaaaacgtgggtggctctgaaaagagccttttgagttcacaggtgccccttcgagacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatactcgaggaccgcagccatgtagacgggcgcgccggcccccactcgctccgcgtagttgcctttgcgcagcaagcgatgcactcgccctaccgggaactgaaggccagcgcgggacgagcgcgacttggccttggcgcgggccttgcctccttgcttgccacgaccagacatgacagcgatagtagtcaccgagagaaactcctgcctggcgatcgggaaagtcgccgaaaacgccgctgcttcacctttttatagacagaacggcgattgtccacggagcactttgattggctcaagcaaattttgtcccgatagccaataggatagctcagccagaatccactcatttacataatctcgtctccctcgcattgcgcgccgcggaaaactcgcgaaccataacgcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtgggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgtactaatgtctttgattacaatttttaaagtatttcccatttttttattttgaaaattttaaacctacagaaaagttggaaaaaaaagtacaaagaccagccatagtcccttcacctggattcaccaattattacaattttgctgcatttgccttatctttgtcttctcatgtacacagacagcctctgaaccatttgaaaataaactgcaaatatgttggcacttctccctaaatatggtggcatgtctcttaaaaataggatattctcctaaatagctacaatcacattattacacctaacaaatttaatgctgattcagtaatattaatatgcaatccatattcaaatttctccaattattgaaaaaattctatatagatgttgtattagtttcttgtggctgctgcaacaaattactacaaactcaatggttttaaaacaacagtcattctcttacagttttggaggtctgaagtacaaaatcaattttactcggtagaaatcaaggctgcactccctccagagaccttaagggagggtctatttccatgccttttccagcttctagaggtttatttctggtttatggtcccttccctctgtcttcaaagcaagcagcctattaatcttcaaatccctctctccttctatcgcctccttctacacttgactttcttgcctctcctataaggactgtggtgattacatttggggcctacctggataatctggcataatctctcaatctcagaatcacatctgcaaaatcctcttggctatataaggtaatattcacaggctgtagggattaggatatggacatatttgggagccacatttagcctgccacagccattgactactgttatgggttgagttgtgtccccccgaaagatatgttgaagtctaacccctagttgcttagaattttgccttctttggaaacagggtctttacagaggtaatcaagttaaaatgaggtctttagggtgggccctaatccagtatgactgatacccttataagaagacatggagacagccgggtgcagtggctcacatctgtaatcccagcactttgggaggccaaggcaggtggatcacctgaggtcagttcgaggccagcctgactaacatgatgaaactccatctctaccaaaaatacaaaatcagccgggcgtgctgacgcatgcctgtaatcccagctactcgggaggctgaggcaggaaaattgcttgaacccggggcacagaggttgcagtaagccaagatcatgccactgcactccagcctgggcaacaagagtgaaactccatctcaagaaagaaagtaaaaaaacatggagacatacatgaaaaaactgaggtagagattacagttatgctgccagaaaccaaagaacaagtggggctaccagacactgaaagacaggagtcttcccctagtgggtttggagagagcatggccctaccaacacgttgatttcaaacttctagcctctaaaaccatgaaagaataactttgtgttgttttacgccatacagtttgtggtactttgacagccccaggaaattagtacaactactaaaattttttgatttagtttatttaaaatttttaaataaaatttcacatctgaaaaaaaaccctggacatttttcctgtgatggtaatattagtctttagccttagtcaagtattaacatttggacatctgttccaaatatgtaattggagcaactctgtcctaattgaccctatttgacttgagacctttcatgaaaggtctttccttttatctaggaaattattattcctgaaatatttcaagattcaaactggtataagtaaatatgtcagacaaattggcttaactggaagtccaaaggtgcagcagggatccaaggttggctgaactccatgagtggctcagttccctgattctcccacactgtgtcctcctctgcatattgtctataatcattcttgccttcatacctaaagacagtccatcctcctgctgcctcttgaaagcaaataagctgctttcccaaaagataatagcatactacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaagataaaatccaacatttgtttccattaccaccattgcactccagcatgtcatttatccgttgtttttcacactttagcatatatcaccatcacccagaaagcttaacacaaataatggaacctgggaattttcatttttagtaacttcaagtaatgctgatgctgctggtctggagagactttaagtcttaatcactgttccagcccacaacactgcaacagcctcctaattgctttcctcgcttctattgtggccagcctaggatttacgatccccagagcaatcagtataatattttgaggttaatgaggctgtgtgattccaagtccagtgttcccaaagcagaaaacaaacctaatcaacctcccttgcaaattggtggtccttctcctcttcagggatcccaaactctggcttcagaaatcgtatattttgttgctattgtatggaacaaacccttaaactggacaagcttttccgagtgataactcttggggaaaaaaaccatttaatggtattgggtagattttagggtatctcaactagaaagcgcagaaggttatcggtgttaactcctggttatcaaaatcgaacttccatctacctccttaaggaattttcacatgagtggtggtgtaggcacgtgtttgtgaaccaatgatataaaaacctcaggtttctcgataccatatataaaagttgagctattcccttttaagtacacatctgagagcatacaatgcatttaatctctaccttcattttaccactgaagagcggacccaacctttgttcatatacacaatttgatcttacataaacttatcaaaattaacactgcgtttctcaacaggaaacaatctcctgggcacatattcacgggtacgtaaccaggccaaagacagttcaagagcagcc

SEQ ID NO: 272 - DNA, 23803 bp, Homo sapiens
tttcaaacaaacatttcatggttggaataaccacctattccttgcctcactaaactcttaccttgggtgtggaagcaagcagatattagatgtcctttttgtatccactaagacaatgatatccaatgtcaaaagtttgcccatgatgggtgccttcactgggtttagctactctttaccagcatctgtcaagtgccccagagtgggaatccaattgaatatagagccacctttgtctaaatctgctgccaagcaaggaagccagaagatgcctccaatgggcccctggaacataagctccctgagaggggactttgtcttgtttcaaactgatccaagtacctagaccagtgccaaataagtatgtagtgaatgaataaatttttgaatgaatgaggcttggcctagaagtcccctgatgaggactgaaaagtctgtcttcacacttactgagacctcacttgtaggaatcagcttccagtggcgggtcaccactgccataacttctggctcccatgaactgtactaatgtctcaacccaaactttcttagttgattctggtgccacctttctacatcttggggtaattcactgacagcaggagttctggtggtactttggagcacagatctgactccacaggcacagctaggtctctgtgcccaggtctagggatccttttttttttttttcatatttcttaaaacattttagaggaattcagggtaccatggtggtcaggagcatgtggtcagtgaaactgtctgggtttgcacggcagcttctgggagaccttgggcacccattctacattgattcccctctgtaaaatgggagaaggctagtatctaactcaaaggactgcagtgaggattaagttatttactgtatgtcaagccactggtacattatgagtcctatataaattatagatcctatgaatacatatccaatttgcaactcctgaaatgatctcattttttcccctttccctaagttcctctcagtatatgcccttgcaaacacctccatttctctctttgcacctgtcacctaattagctttcaaggatcccttcctaccccgtcaacacccagatcttccctatagaaataatatgaatgttttctctgcagccgtgtgtccttctgcaacctctttccagtcctaacacataaactcctcacggtctccctatgaatggagataagtgacatttctcattcttcttgtcctgtgaggcactcagcctgggagataagaaggggaagagcaatggagcagctttgggaggggcaaaatagaaatgtaggtggagaagagaagctttatttttcacagagtgagacataagtgctgctaagcactgaacagaacatgggtgtggagacaaccatgagggacacccagggagaccgctggagatcactgacaaccctcttcaggatgaactcaggagctcagaccatgggcaggaggttaggagtgggtacatcagactgaggttaatcctgggcactttggtctctggttcctttaaaattgctcatctcaatgtactgccaaggtcagcagtaattctctagcaatggctggagcccctggcaggctcactcacagcagtagaggctgtggtgcctgtgccagtagaaaagatggggcctttgataggtcaagcagcagtgccccactaaagttaaagtgacccctgaactggggctgcagggaaaggctggaggtgggtatgaggcttagtactggggtgtgcactttgaaggctttgggggttatcactgctgctggttttgctggagggcatctcagaagacatcaatagaatcagatgtgcttgtaatgcacaaacctctgtcaatatctcttctgtgatgggtgtcatagaccccatgctctcctactgaactaagaaatacacggaagaaatgaaaagttacttggagttagtttaccttggaaaaatgcgtttttctctggtctcctactagaaaaggatgctgagtcttttctaactgggcccctcaggtatcttatctccatgtaatcacagaggagaataagcctgtttgggtaaaccttccttgatgatgtctggtgagatcagtgcatctcgcagaacaaatgtaggaagaagatgagggtgtgctgaaaacccattaccttcacagtcacaggacacctgaaacatcctgagagggtgcccattaaccccacactcttcctggtgcctccatcccagaccctctgcttccttctcccctgatggaagcctgggcttgtcttcctaggtcttccagctcaggtcctgtctccagctagacatccatctgatttcatagaagccagagaatgctgattttgagaagtcagtggactggggagcccaggacaggagctcctagcatgtgaggggcagcatgagtgggctgctgggggagttgacagcactaagtaccccagcccagcttcaggacttatccaccttccctggaacaggatggcatgtttgaccacaaagagcctggtcctcacttgtgcatcttccacccaggcctacatgtgtccttaaaagaggctgtgccctgtgctttgtggtgaaaggtagagttcaatatgacatgtcacctgacctatagaaattaattgtctaattgcacagacaaacaagtaaatagggagcctgcttccatgagaaaattgctataatgtaagtcactatgcacaaagtttgcaggtctttgtccatatacttctttctagcatgttcccttaggaaaaccaaacacccagatgtggtgttggggtggtgacttgctgttggggcggtgactgagctaaggacgctggacattcagtatgggctgtgtgtaaaacagatggaagcctaaagtcaggggaggtgagggtccctgaaagagcccccgggcaggagaggaggggagtcaaatgagtacccgattgaagggcaaatgtagagaaggaaagtacaatagttgcagtaataagagtcacaactgacgcattataaaaaagcatgaccttccatcaaaatccaaggaatgcgtgctctttatttgaagacgatgaaaacactgagggaggagtcgttcatctgcttggactcggtaaggaagttgtgcaaatgtgcatgataatggatggccttgatgaagatggctttgctgtacgtgttgctgcttatgaggttgatggtagtgctgggtgcatctcttgtaatgaagctgacctgatggtgtctatgtttgggtatgccgaattggtgcaaactgaatgctatttccttgttaatttcattttaattttaaatgaatttatcattcaattaatctctaatattaaaagaccttttgctagatatttttcaagataaatcacagtcaggtctataaccaaactttagccatattaaaattataattttcaaagaaaattaaattatgttcattatcagtgggtgtaatttttctcttactctgcctaagagtttgcccctttaagtacatagtgatgcctgtaggagcataaatgcaccgggctgtaaggaggacagtggctctgtgtggatgggtagagggtgggtgcagattttgatatcctcagcagccttttcctgcctccagcccatggtacctgcctctggttgaaaggtattttcagaatcatttccagaactactcctgagtggccgtttttctcatattgtttagggtttcttcagtagaccctggcctgcaaaaaggcacttaagaaaaatggaccaagtactttctcatggtacctagattgtgaagctgaacaaagctgggtggccacttttgcttcttaggtgtagaatctctagtatttgggatacaacaacagaggagtaagttctaaagtttcaaaacaccccagaactgtagtgggggccctccttctgtctcatggaatgcagcagatgtgtgcatatgggcctctccacagcccctcccccgatgcctggcttgggaggctccatacttgtcctggtgaggatgcccaccaaactttcttcccctccacgaggaactcccactttttggcccctctgtttgttatcagagcaggagctctgtaggttcaaggctgagcaggtgtcctgggatgacagaggcttggctggaggaccactgccctgccacttacccagagcatgacatcagctctctgagggtaatctctaccaggagtaccacccttagatctctggctttctaaggttctgtgaggtcaggtgacaagagaacctggcctggctggatatatctggataatttcatgacttagtagtgccaatgggaatgatgggcacaggtggtatagtggctcaggtttggctctttggagtgcattttaatcaggtcatataaaatacacgtaaatgactatctaaataacaaaaagatctttttcattccctgcagaacacagcttcctttcagtttaggaccttcccatccccaaaccattagcatgaccatggcaagcagctgagacaatctgggttctcaatgttatccttgtgtccctagtggagacacaggtaccacagagagatgtgaagccctccatgtggtggttgggagtaaaaggggaatggaagagagccttactaatggaaaagatccaggaatcccccaaactgtccaaatatctgttctttaaatcttctgtaggcctaccatctcttatttttctttttgtccttcctcccctcatcccttctcttcttccttcctgccctcctgcccttctctttcccttcctgccccctccctctctattccttccccattccctttccctttccctacctttccctccttctgtcattctttccttctttactttggaatatgttgagctgaacaactgtaatctctattactacgccctctatatcttcttgggcagatgctaagagtttttttgtgaggaaagtcacaggactcttgaaattcctggggcccagccttcctgtaggcctgtcactttaattttttctttcattcagtcatccatttattcaattattcaagtgagatgtgttgtgctgatatggcacaccaggcattttgctatacacaggagagttataaatgaataagatttgttctctgttcttgagtagctcacagtgcagtggggcagacagacaaataacaaaataagcatgatccaatgtggcaagtacaggaatgcaggtgtgtggaatgtccttgggctcaagttcagaccctttgggtttcaaaccccttttacttggagtgactctgtgggggaaaatgtgtctagatgttgccacatgctatcatttgaggatgagatcactggcctttgacaatagtatctgtgcaagtagcaggagcagaggtataaatccttgatctgtctgtgggcagccagccaagatggtgataccaagaggagctaatggaacccagctcatggaacctcaccaggaggaagagataatgctgttgctaaggagaagagagctgagggggaccctgagggatctaagacaaagtggagggggcaggataatgggcttgttcagagcattcattttggactcagacattcctgagtttgaatcctgcttccccaggtagcagctggtatcaaggtgggaagctataaagtgataagaggcacaatggaccaaagatgtgaggggcaaaatcagagaaagagacaggaagtctatagaggctgtgaggacatggtttacaaattaaagtacatctgagggccattgtatcagtatcttagtgactgtggtatttactctaagagctccagagtagtttcagggagggagtgatccaccttagttggggtggctaagggaaattagctgagctgtgaataatacttcatggatgtagtgatgatgaggccaacagtggggaagcttgtgaacactgaatgggcagtgattgaacaggatttagcaaattgcaattacataagctatgtagtattttttccattgcattttatataacattagagatgcattgcctctgaaacaccacctttaaaaatgggacaaatcttttaaatcaaaaacacgaattaaaatgatcacaaaatgttactgtcttttataaacgttgatgaaaattttgtgtctggttatcctgttacagggaggcgtataagtgatgaaatctccattagatgatgaaatagttaatatttgtgggatgaaaagtgaccctgtgagaagaggtttattcacagggctgtggagagagggagggagatggggaagggcatgaggagagaggcctgcttgtgcaataactttgtccccttggtagtcatgatttatcctttcttctttcttggctgttgtcttttgatgtggaagctagaaaacacttgatgccctttccttttgtcaccaccaaagccactgtctcagagcctcaatattttgcctaggctgagtgtcttctctgggtttattaaataaacaccagtgtccactcacctccagaggctgagaggccaactgaggagaaggccactgtgattcactctgcgatgcatgcaaaatcgggaactgtctcctttggaccagttttgaatgtgaggtcccaaaagacagaaatttgtctctctgattccttattgtgtccctagtgcctacaatcaagcacataatcaatgctcaataaaaatgtgtcaagtgaataaatgggtccagggctcaggacttggtattgcccagatgcagtttgggactttgtttttctctgctgctggaaactcccttattgggctccatttttgagaggtccttttatacttctttatagattcccaggatctcattgatttgccagcaatgttgactctgctccattttctctccactcagattcgatccaaccatagccagaaccccgtcattcttcagtgtagtggaatgaggtgttctgggcctccaaccttgttctgcagcccctgacaggaggcaggctctaattctccagttttgtccagcctgtgtcatgctgcttccaggtctgcacagagatgctgggtctgcatgtgggtatcactcacattccaagtgtggagctttgcaggctgtatcagccatggcacactcttccctgggggcaggcctttcacccccttcactgtccctgggtgagagctctctagtgatttcaaaccgaacttaaaccaatggcccaaagctgtgcctcctgcttcaatttcaacaaatttctctctttttttaaatacctattggtgcgtatctgaatatctgatattaaacttctctcaggttctttttttttcttatttttggaggtggagtctcactctgtcacccaggctggagtgtagtggcacaatcagctcactgcaacctctgactcctggttcaagcaattctgcctcagcctcctgagtagctgggattacaggtgtccaccgccacgcccagctaattttttgtatttttagcagagatggggtttcaccatgttgtccaggctggttttgaactcctgacctcaagtgacccacctgccttggcctcccaaaatgctgggattacaggtgtgagtcaccatgctgggcctcagggtctttttgatccctaaattttaagaattaatttataggatttgacaaaatccttttttagttcaatggacttataaggttatccatctttatttttaatgccccccctccacctgctctacttagccctcacatcaacttctcttagtatttgtaatttgactgtagctctacgtgacacttctctggttttctggtagtcaaagtgagatgttactcttagttcacataaaaaaacattccttcaaccccaggagcatctcagtctcacaatttaggccaaaacatgtgactccattgaagttgtaacttccatgtgttgatgtcaaggtcgtgtagttacaaaattaataatttgttgcttctttggtatatctatttataattccaggaacacttctcattttctgcctttttctttttcctaaaattctcattttgcacattccaataatctcattgagtaaactcccagccacatctctgctccattatctcattaatttaagcacctctctcagctttcatctctctccctggattttcagtcactgagttatacttcttcccaaggcttacatctcttccctccatcttttgattctgcttctcttctgcctattttctgcttttttgccttttgatttccggtttcttagttagcactccagaaacagctcatcaaaacaaactagtggtcttctgtcatacactggaaattccccaattgtattaatgtcctctcagattttacaggaaaagtcaatttttgcactgataccctctttgagtttgaggttgagtttcagggcctcaaaccagcacaacctgtgtcgttctctccctcccactacaacataaaactctccccttcccttccatcagtggagcggggtcggatccactatgttttcctggtgcagagataaggtttggctcctgagctgggttgtactgaccaaagagctgaggagagagactgtgaaatgcccagtgggacgctggtggtaatgaggacaaggaactttatcttttttacgaggttgggcacaagcactgccaatccttggcaggtacaggggtagggggacatatgacatcctgtacataaaacaagaagtgccttctggggagagctcagatcccccacaggaaaacctccagctcagcctgtgaaagtcagaagagggtatatgggaaggcatgcgtcagatggggctgttcttggcctcttgggattcttgtttcctccaaagatcgcttgtctcagcatcaggatctggatcagcagcagcccccagaaccgtggcagcagccagagcccccgccttgctgaccactgcccctgtcacaggagttggacctctggcgccggcatcggtggtggcgcctgtggtggttcaggaagcagccgccctcggagctagggccacagcccccagagcttggggcacagccagaggaagctggaggcagacactgtactgggttctttgggggacacttgggtgaggggcacttgggtgggggttggcactgcttctggttctgctggcaggacatcttggcaggagttgagatgtcctggagaaaacgaagccacttcttagttcaaaatctacagtccaacgtctctaagaccagctgcctcctgaggcaagagctgcaagagggtgagggaagctgatgtggagctggtgggatatgccagatacttctcacattgctctccacccgggacagattgctgtgagtctaagtgggcacgtgtgtttctgtttctccaaagaacccctagggaatgcacccttttgggaaaaagaattctgtagaatggatgttacaggaaatgtgcctgcctgagtagaaagaggatgggagggaattgtgagctctgtggcctttgcaggtcatggaattgctgtcagttcctgcagggtctccctcctgcccccttcccccattgctgccctctcacagtcctgtatctgggtctttgtttcaaacctctctgtttccatctcttctgctatggccttagctttctgttctaacatcccatatcaagccctgtcccctgctgaatacttaccaggtgcagagaggcaggagaaggctgttcctgaggagactgtggaggagcccagggcaggagtgcttttatcctgtgcagggtgtgtgatgcacaggctgggcatgctgctgctttcacaaccaggggaggtgacagccaggcacacccttgagactatccattcatcaccttcctgtgtactcaccaagatgcctgacaagagggaaccaggaaggtctgacgcctgtttaccttcacctcattcaggcctgctgggggttgcaatcctaccttccttgaagcaattgtttttatcaccactcattagtagtcactccttattccacattgcccctctggcaactagtaatcaattttttgcctgtatggacttgcctattctggacacttcatataaatagaatcatataatatatggcattttgcattagcttctttcacttaatatattgtttaagatttatccatgctgtagcatgtgtcagaactccattcttctttatggttgagtaatatttcactttatgaatttagcacgttttatttaaccattcatcaagtgatggacatttgagttagctccaatttttggttattgtgaataatgcagctacaaacttaatctttattatttccttcctcctgctttatgtttagtttcttctttttttcagtgttttaaggcagaaggttaggtaattgatttgagatttttcttcttccttaatgtaggcatttgcagccatgtatttccctgtaagcatttcctttgctgtatcccataatttttggtatgttgtatttttattttcattcatctcaaagtattttctaattctccttgtgatttctttctgaactcattggttgcttaagacatttctgaattttccagttttccttctgttattgatttctagtttcattctcctgtggttacggatgatactttgtatgatttcagtgttttaaaatttaatgatacttcttttatgacccaacaaatggtctaccctgcagaatgttccatgtgcaattgagaaaaatgtgtattctgctattgtggttggagtgttcaacaagatgtctgttagatttaattggtttatagtgttgttaaagtcttcagtttgttgattttcttcctagttgttcttccattaatgaaagtggagtatgaaagcttcaagtattattgttaaattgtttatgagttgtctgtttctcccttcaattttgttagtctttgttacatgtaatatgggactccattgttaggtgcatatatatgtataataattatttctttaatagatatggatccttttgtcattataaaatgtcctctttgtctctgccattaatttcgtcttaaagtctatttcgtccagtattgtatagccactccagatctcttgattaccattgcatggtgtatgtttttctaccttttactttgaatctattttgtctttgagcctaaaatgtgtgtcttatagatagcatatagttagttcatgctattttatccattttgccagtcttagccttttgattggggtatttaatctattcacaattaatgtaattactattaaggtagaatttatgtctaccatttactatttatttcctatatatttcataactttctttgcccctctttttcttcactatggctttgttttttattgaacaggcattttctagtatacccttttaatttcaatgttatatattttagtatattttttgagttattttcttagtggtttccttgggagttcttattaacatcttaacttacagtgattataactcagatcaataccaacttaattttgatagcacgcaaagctttgctcctgtgtaggtttgttccctcccccttctgtatactgttattgtcatataaatcatatctttacattagaaggccatcaatgcagttctataagtatttctttatgcagttgtctttcagatcaaattggagaaaaaagacttaaaagcacaaaatgcatttatactgtcttttatatttaccatgtagttaactttacaaatgctcttcgtttcttcataaaaatttcaaatactctctagtgttatttcatttcagactgaattaatccttttagtattttttgtagagtagggtttctggaaacaaattttctcaatttttgtttatctgggaatgtcttaatttttggagaatagttttgctggatatagaactcttggtttactttttttttctttagcactttgaatgtgttatccaactggcttctgtcctccatggtttctgatgagaaaccagctgttaatgttattattaattttttttgtatatgatgggtcttttctcttttgctgttttaaaaattctctctttgtcttttgacatttgtactatggtgtgtttaggtgtggagaggtttgactataccctgctaggagtttgttgatcttcttagatgtgtagattaatatttttcatcaaatttgataagtaattaactgttattcctttgaatattcttcctgtctttttatttctctcatctcctcctgggattcttattataaacatgttggtgggcttgatggttactcacaggcctctgaaggctctgttaatttttattcaatcttatttctttctgttcctcgggttggataatcacaattgacctatcttcaagttcactgatttgttcttctagttcaaacctgctgttgagcccttctagtcaattttaaatttcagttattatatttgtcaagcctcaaatttctatttggttgttttaagaaattctttttaattctttgttgttattctctatttggcaagacaacattcttatgttttcttttaattcttaagacgtagtttattttagtactttaagcacatttaaaatagttgatttttatctttgtctagtaaaaccaatgtttaaacttcttcagggacagtctctcttgactacctccctggactttgccccttgtgtaggtcatactttcttgtttatttgtagctttctttcttttttggttaataattggacatttaaaatgatataaaatcctggaaatcaaatttcccaaccctctctggggtttgttgctgtttgttttcactgtccatttgcttcatgactttcctgaaccaattttgtaaaatctgtattctttattgtgtgtagtcatttaactctgtactcagttagcttagtagacagagatttccttaaatgccttgagttaatgtctttcaacctttgctgaggacctctgtgtgtatgttggggcatgttttcaagacttcagaagacagtttacaaatctgtcttaggtttcatttcctgcttggatggaacttcaagatcagtcaaagttgagatattagggtcttcccaggtcttttctgtacatgcacacaccctgtaagtccacatagtctcctagatttccagaaatgtgtcatagatttttaaaactctctatgagaatctcattcctcagattttccatctaagtttttggtcaacttctgatttgcccaactattatcaccatcacaggcagctgtgatgctaaacattttttactgattgtttttggcaaacaccctggggtaaaagctgttttcagtgagagagttctgagtcaactggaatgaaaacaagcttggctagttgggatttctaggggaaatgggaatgggatcttcattatgtgccatatagtcagataatgacatttctctagggatggggtttttggatagtttcagatatgttctgttacctccatgtgctactagcattttagatttcaagactattatggcactgggaacagggagatgataatagggcaagttaaaatgtcacaaagctcactgctcttacccatattcaactgcttttcttaagtgaacactctaatatttttgcaagcctttggtaaatctccagagttttgcaaaagttgattttcacaatttttcattttcaaggtgtttttaatggaagagcagatttttggagatccttgctcaatcattcccaaccttgtcttcttaagtgaaaacatgagtccctagtttttcatctgggtcacaaacttcacatccaataagcattattattttgagatatacagctcttctcatcaccacagagatgcttccatataatatccaggtcatatatgagaaagtaagattaagcttttcctgttttattgagatttgacaaaaataactgccaacttgtaaacaataggcacaaataactctccaccttataaagaggttggaaggagccctgagatgctatcactcttctcttgttatagtaatgagaagttttcaaaactggatagaatgctgtggattttccccttacatttcacatggggaagcaacaggttattactcttaccctccactagaggaaaagtcatagaaatttcaaggggacaaattgtagaacttatcaatgcctaaaaaacagaaagacttggccagtagcggtggctcatgcttgtaatctcaacactttgggaggtgaaggtgggtggatcacttgaggtcaggagttcaagaccagccttgccaacgtggtgaaaccccatctatactaaaaatacaaaaatagctgggtgtgttggctggtgcctgtaatcccaactacccaggaggctgaggcaggagaatcgcttgaaccagggagacggagtttgcagtgagctgagattgtgccactgcactccagcctgggcggcagagcaagattccatctcaaaacaaaacaaaacaaaacaataaaacacacacacacacacacacacacacgcaaaacccaggaagactaaaatttcaggtctcagtgtcatcattggacttgctgaacagttctctggctattctggagagtgaaaaataattggaaagggaaaatggaaaggagaatggggaaaagagaagcagccagtcccttactgcttgacatggccagagttcatgagtttccctgagccagtggacagtttggagggcagctaggcatagctgtactgccacagtcctgctgggaatgtggctatcaaggcaagaggcctgtaccaatggggctaagagtgcaggggagtgtcaaaagaggccaaatttttcacatcaggtcactgtgctaaaggttccttaaagaaatcagtcatttatctggtaagagagccctcatgggtcagcacagagaggatgcagccactgagagacactagcagtaccagccaaatatgagatatttgctttgtccccccttttctcattccggcctcaaaacagtgcagaataaagggaacccgcaggggagaggaggaggtggacaataaatgatggaactaaccatgtctcttttccacacactagatgcctgttttccacacagtcctttaggagacagttgggctgtgctgggttggagagggaggagttaatattcttattctgagttatatccaactggacaggataggatgcttcctgaatacctgaaaaatgattagaaaggcctgaaacacacttgagatattatcaaagtagagtcagtataacatagtagaagacagagactagaggaaaaataagtcactatttgtatctgacactgagttcagactacttaataaacttcagaggcccttggaagattttcctgccaaggatctctcttggttcttcctctctttccaatatcagtcaataaataaatcaatactcaatttcataaattgcataatattttttaaactgcatttaggaaaacattccttcttggagctaattatcactgtaaaatcagggctttgtggtgaaaaatgtgaaagacttcagatgtcaacaatgaaaagttttgtctccaaactccatgtcaccctcaaaaccttcagtttctgtgagctatcttgggtggtctgtgacatgatctttctttactcttgagctgggctccaattttcagtacaggtcatggtgggcctggagtgctgaggaatgggtcagacctccaatcatccagggggctttgagttgctaagagtggtgtagggaaggcagataaagttgaagaaagttttgttatttcagaaagtcacatatagaaagaggagatgggggtcggggaggtagggagaagatggatgccaggagatcagggagggtggaatttctggagagaagagaatcctctacctcagaagttctcagctttggctgcacattggcatcatcttggagggttttttaaaaatacaaaactctgagtttcatccctcaagacgctggttggcttgggctaggcatcagggttttagtatctcccaggtgattctgatgcacagtcaggtttgagaggatcagatcacatgaggtggaagagaaagaattggaggttggagaatgagatcacctgtgggcttacgtgcatacgtacctattgtccacaaaacaaacaaaaaattctttggctacagtactagtctctggctggtcaggaactggctgatttctctagtctcaacttctactatcctcttctacttctttacctgtctttgtcacaccaaggggtctgaggcttctccctgggcctgagctggggggcaccttagtgactgaagcttggtgctcagggagtgtctgtctgaacaccttgaggaaagaggcagatgtctcaggaagttctagttcatagactctctggacaggatcttgttaccaggttctatgttgcttgcttataggctgcagggtcctggtagtaggcgggggggcgggaggtgtgggggaggaaagagtaagtttttctaagagaaggatctgggatgccccaagactgtccgggtacctatttcttaagtttgtttttggtgtgttttcttctctttctcccatcctcttttgctctccccctctctttacattccttctttactttcttctattctctaaaaaatgaacagatattacacagtgggcatggtgatagatgtgcaatccattggatggtggacacacctaattataaataaatgagatgtggttctggttgagtagctcaccttgtagcagggcagacagacaggtgatcaaatgactatgacccaagatgatgaaagctacataaaacatgtgttgagtcctgaggcttatgcaagagcttttggctatcagtctcctgtctcctcagtgtgcccagaggttgtcatttggtatcacttgagagtagttgaggtgaggtcagcagcctataggagctgatgatgggcatggagcaggaacaaagggataaggagtctgacctccccttgcagtttatggtcagagagacacagagaaactcatgaaacctaggaggcagaggtgtccctgcagagagaagggggatggacaaaattcctgtctgaggacagaatgtggtggatagaagcggccagaataataggttcattaagaacataggttggggagtcagatatttcaggctttgttttcttatttcttcaggtgatagttgtcataaggtaaaggtgtttgaagagagaaaaaactacaatggaatgaaagcacagtggaccacggatgttagagctgcaaccagagatggagataagaaactaacctacatctgatgaacgatgtgtcagtaagccactcactttgtaagtttctgagttgcagacatgggtcagagaagaaggtgattcacccaggctgggatattcagggagaatttatctgaaaggtaattataattaattgaaggtgaataattatagatacattttgtagtgttattatgtatacctgatgtaatgcaattgatgtgtgactaatgcctgtaaaaactgcatttgaatcagctctgtagaattttcctattgcattttattataacaataaagacgcattttcttctgaaatataagcatactcaagaataagacaaatcttttatatcacacaggtaattaacaatatgtatttttttcagacaaatacaccagtggttcagaatagaaagccaaaaaataaggccacacacctacaaccatctggtattcaacaaagctgacaaaaacaagcaatggagaaaagactcctagtcaatacatggtgctaggataactggtcagccatatgcagaagattgaaactagactccttccttacaccatatacaaaaatcaacttaagatggatcaaagacttaaatgtaaaacccaaaattataaaaaccctggaagacgactgaggcaataccattccagacatagaaatggacaaagattttatgacaaagacaccaaaatcaattgcaaaaatgacaaatgggatctaattaaactaaagagcttctgcacagcaaaataaactatcaatacagtaaacagacaacctacaggatgggagaaaatctttgcaaactatgcatctgacaaaaatctaataatatccagcatctataaggaacttaagcaaatctacaagaaaaaaaacaaacaaacaacccaattaaaaagcaagcaaaggacatgaacagacacttttcaaaagaagaggtgcatgcagtcaataagcatatttttaaaaagcccaacatcccactgatcattagagaaattcatatcaaaaccgcagtaaggtatcatctcaaaccagtcagaatggctgtcattaaaaagtcaaaaaatagcaggtgttgtaaggttgcagaggaaaaggaatgcttatacattgttgacgtgagtgtaaattagttcaactgctgttggagacagtgtggctattcctaaaagacctaaggaccaaaataccattcaacacagcaatccgttactgggtatatacccaaaataatataaatcgttctctcgtaaagacacatgcacacatatgtttattgcagcactactcacaatagcaaaaacatggaatcaacctaaatgctcatcaaagagagactggataaagaaaatgtgatacaggtataccatagaatactatgcagccataaaaaagagtgagatcatgtcctttgcaggaacataaatggagctggaggccattatctttagcaaagtaagacaagaaaagaaaaccaaacactgcatgttgtcatttgtaagtggcaggtaaataatgagaacacatggacacatagagaggacaacagacacagggacgtaccagagggtggggaatagaaggagtgagaggaccagggaaaatgactaatgggtactaggcttaatacctgggtgacaaaataatctgtacaacaaatccccatgacataagtttacctgtataacaaacccgcacatgtacccctgaacttcaaataaaagttaaataaaaatgcacggcttttgagaaaacattattagtacagtaaatgtgtctgtttatcctactacaggaaagcctatagttgtggctacccactttgagataaggtctaacaggaggaaaatgagagtaccttcatactactggtgcaaacattattttttccactggcagtggtctgagaacataggccttctagtgcactaatattcttctcatcaccactagcaactcatcccttattcttacttgattgctgtctgtggtataaaagtaaggtgttactacatgagctttttgcagtagcaaagccagtatatttaatcatcaatgttgttctcaggctagtgtctttcattgtgtttatcaaagctacactgctgcctcctcaatccagagatatgggaaaccaactggatagaggggtgttgataccttactttgctgttttacaagcaaatcagaggactgtcttgaatggacccactagattggaagttccctgagaacatcttattttttcattttctctaatgtatctccagtatctatagaggtgtcagtatataatagatgtttaataaatagtttttaaataatgaatgattaattattaattattgaatcctaggctgggttgaggtggtctttattagtgacctgttggggtccacttttaggggcagcatcatgaactgcataacatctatctttgactgtcttggtattgcaggttcaaacttcataagttggtccaactcctatttcttctccctcctgagtggactcacagtgggtgtaagaattggcggacaatttgacatcaagagcttgaccttggtaggtgcttggagcctccagtcctctttccatagactttgatggcaggctttatttcttcaaaggctggatcttttctctttcaggtgatatgcagttaggaatttgtctcatgaattctagtcctgctctaaacagtggtcctcagtttctggactagtggagtggttctggctagatctgtgggctccttggtgtggggtccatgtggcaaggcctcacacacagggtagcaactccaacctcccaaccaaccttatgcattctcaatatttttgagacatatttgaatcatgacttgacactgtttctgtcccatggtggagcgctacccaagaatgtctccagttttgagtaacaagcagcttgtggtgatgaatcaaacaggacggctgtggttcctactttcagcaactgtgctgagctggagagtaatcagaactggttagagtatttctcacatcagactccttgagagcccttttctttactaaatttcagagattttagaaatcctgagttcttagactttgcagtaaaaataaataggcagtttgacgttttcaaaaggatatttttgattcaataaactcctaatgttttatctatatttatttatttttgcttgttgtacccagctccacacagagttctcccacattttcaatttgtaatttaattcatgtcctgtggtgttcctttggcttattctaagaactatatgaatggctttgatgaactgtttctctaagctagtatttcaacaatctgacagacagagagactcatctctaaggaggtaattcagcctagagggcggttaagtatcacacatccaaaacatgacagagaaaaatttttaaaaagttttattgaagttatgagtcacatagttgggctcttagctctgcagatttaaaaaaatcaaacaaaaataaaaacaaaacacgaagttaaacaggacaaaataaatgtaaagtagaaaatactaattgtttctaaagatctcttgaaaagtctccagggagggacaagtggcatcagcgaggatcacggacttattggctgggtcctgtgcagaactgttggacccacaatttccctgtttgtaaaatatggttattaagagcacctggcttatcgagttagaaaattaaatgagttcatagtagtcacttagggttttctagcacctaataagcaaataagtttttgatcttacaattattctaatttataagcctagcaatacttctcattttctctcttcctttatcttaatggtctcagtccacaccttccacattactacattccctaagctctcagctccatttctcccctgacccaggacttcttaagctttaattaattctactccctccaccttctctctctgaagatttaattgtgtatgtggagttatctgtttttcctgagaccagctttttcttttttcttttcttttctttcttttctttttgaaatggagtttcactcttgttgcccaggctggagtgcagtggtacaacaggctcactgcaacctctgcctcccaggttcaagcaattctcctgcctcagcctcctgagtagctgggattacaggcatctgccactatgccaagctattttttttttttgtatttttagtagagactaaccatataacatgtggtttcatcatgttggtcaggcagtctcaaactcctgacctcaggtaatccacttgcctcagcctcccaaagtgctaggattacagacagctgaggccatgtttttctttacccatcttttaattgtagtctaaaggttttcagccttgcaattattggacttcttggggcagataattctccactgtggggctgttctatgcttagtaggaggcttagctgcatccctggcctctacccactagatgccagaaattctctttctacctctaagttttgacaacaaaaaatgtcccttggagagtcaaatttacccctttagaagaaatgctaattctgcctatttttttgataattgcctgctacatcttcactgttttgtaatagagatgtcagaaacatctagtagctagctcctcctacgactggggagtccattatgagaggacaatcacatttcagtcattcttttctgacagttagaggcctcactacaacccctctcatcacatcctgtcccccactgccgcacaattccagcagaaaaggactcgacagattcctgaattttgcagacctagagctagaattctgcatcttccctgtggtggtgctggatgtcaggggcagacaggagggcacacttccagccccacctagggagagacagagtgaaatgccaagggagacaccagtggtaatgaggacaaggagctttattttttgatgaggtcaggcacaagcactgccaatccttcacaggtacaggggtaagggaacatgtgacatcctggacatcagacaggaagtgccttctggggagagctcagaccttccacaggaaaacccctagctcagcctgtgaaagccagaagagggtatctgggaactcatgcatcaagatggggttttcctgggcccttgggattcttgtttcctccaaaatcgcttgtctcagcatcaggatccaggtcagcagcagcctccagagccatggccgcagccagagcccccgccttgctgaccactgcccctgtcacaggagttgggcctctggcgccggcatcggtggtggcgcctgtggtggttcaggaagcagccgccctcggagctagggccacagcccccagagcttggggcacagccagaggaagctggaggcagacactgtactgggctctttgggggacacttgggtgagggacacttgggtgggggttggcactgctgctggttctgctggcaggacatcttggcaggagttgagttgtcctggacaaaacaaagccatttgttagtccaaaatctacagtccaatgtctctaagaccagcggcctcctgaggcaagagctgcaggaaggtgagggaagctgatgtggagttggtgggacatgccagatgcctctcactttgttctccaccagggacagattgctgtgagtctaagtgggcatccatgtttctgtttctccaaagagcctctaggaatgtacccttttgacaaaaggcattctggagaatggagatcataggaaacatgtgccagcctgagtagaaagaggatgggaaggaatcataagcttctgtggcctttgcaggtcatggaattgctgtcagttcctgcagggtctccctcctggccccagttcccacattggtaccctctctgccatcctctctccgggcttttgtttcagatctctccatttccctctcctgctatgaccttagttttctgttccaacatcccaagttgagtcccatcccctgctggacactcaccaggtgcagaggaggcaggagaaggctgttcctgaggagacggtggatgaggagcccagggcaggagtgcttttatcttgtgcacggtgtgtgatgcacagcctgggcatgctgctgctttcacaaccaggggaggtgtcaacaaggcacacgcccaagactaggtttgtagctttggcacttccataatatccaaccaatgacattgaacctggaagcaggatcactgtccacatacctctcacctgggaggctaccactgcttcttttcttcctcccttcttccttgtttcaactcacgtgctgtggag

SEQ ID NO: 273 - DNA, 38849 bp, Homo sapiens
attatgagaggacaatcacatttcagtcattcttttctgacagttagaggcctcactacaacccctctcatcacatcctgtcccccactgccgcacaattccagcagaaaaggactcgacagattcctgaattttgcagacctagagctagaattctgcatcttccctgtggtggtgctggatgtcaggggcagacaggagggcacacttccagccccacctagggagagacagagtgaaatgccaagggagacaccagtggtaatgaggacaaggagctttattttttgatgaggtcaggcacaagcactgccaatccttcacaggtacaggggtaagggaacatgtgacatcctggacatcagacaggaagtgccttctggggagagctcagaccttccacaggaaaacccctagctcagcctgtgaaagccagaagagggtatctgggaactcatgcatcaagatggggttttcctgggcccttgggattcttgtttcctccaaaatcgcttgtctcagcatcaggatccaggtcagcagcagcctccagagccatggccgcagccagagcccccgccttgctgaccactgcccctgtcacaggagttgggcctctggcgccggcatcggtggtggcgcctgtggtggttcaggaagcagccgccctcggagctagggccacagcccccagagcttggggcacagccagaggaagctggaggcagacactgtactgggctctttgggggacacttgggtgagggacacttgggtgggggttggcactgctgctggttctgctggcaggacatcttggcaggagttgagttgtcctggacaaaacaaagccatttgttagtccaaaatctacagtccaatgtctctaagaccagcggcctcctgaggcaagagctgcaggaaggtgagggaagctgatgtggagttggtgggacatgccagatgcctctcactttgttctccaccagggacagattgctgtgagtctaagtgggcatccatgtttctgtttctccaaagagcctctaggaatgtacccttttgacaaaaggcattctggagaatggagatcataggaaacatgtgccagcctgagtagaaagaggatgggaaggaatcataagcttctgtggcctttgcaggtcatggaattgctgtcagttcctgcagggtctccctcctggccccagttcccacattggtaccctctctgccatcctctctccgggcttttgtttcagatctctccatttccctctcctgctatgaccttagttttctgttccaacatcccaagttgagtcccatcccctgctggacactcaccaggtgcagaggaggcaggagaaggctgttcctgaggagacggtggatgaggagcccagggcaggagtgcttttatcttgtgcacggtgtgtgatgcacagcctgggcatgctgctgctttcacaaccaggggaggtgtcaacaaggcacacgcccaagactaggtttgtagctttggcacttccataatatccaaccaatgacattgaacctggaagcaggatcactgtccacatacctctcacctgggaggctaccactgcttcttttcttcctcccttcttccttgtttcaactcacgtgctgtggagcacagtctgtcctttacaatttcctgggaattagtatgacataattctttcttgagtcatgactggagaaataatagtcatttcaacaaatagagatgaaataattggacgtccatatgtaaaagaaatcatacctaatgctagatataaaaattaatagatcataatttaaaaaattaaactatgaaacttctgcaataaaacataataaatctttgtgactttgggttatgcaaaatttttcagatatgccaaaaaggtacaattcaaaaaagaaatataggacttcatcaaaattaaaaacttctgcttttcaaaaggcactgctaggcaaatgcaaagaaaattcacagacttggagacaatattgtaaaacacaaatcttaccaaggacttggttcaagaattttttttttatttttattttttgagacggagtcttgctctgtcgtccagactgaagtgcagtggcgcgatcttggctcactgcaagctctgcctcccgggttctcgccattctccctgctcagcctcccaagcagctgggtctacaggcgcctgccaccacacccagctaatttttttgtatttttagtagagatggggtttcactgtgttagccaggatggtctctatctcctgacctgtgatccacccgcctcggcctcccaaagtggtgggattacagagccactgtgcccggccaatgttttttaaattctcaaaaataggtaataacacagaaaatatgggcaaagtatttgaagagtcattttaacaaagaagatatatgggtggcagttaagcacatgaaaagatactcaacctaatcagtcattagagaaatgcaatttaaaagcaaagtgagataccactctatacacattggaatggctaaaatgaaataaatgacaatatcaagtaatatgagggatgtagaacaacaagaagcccaagtcattgctggtagaaatgcaaaattacattagttggcagtctatcaaaaaaattaaacatacaacttacaatttgccccagaaatcctattcttagatatttagccaaaagaaatatagttgtatgttcacagaaaaacctgtagcccaacatttatagtggctttattcataactgccctgaatttgaagaaccccacaagatcttcaactgatgaatagagttttaaaaatggtatatttatgcaatggaaggctacttagcaataaaaaaggaatcaactactgatatataaaacaacagggatgaatctcaaatgcaaaagaagtcagactttacatactacatattatataattttaattatagggcattcttgaaaaggcaaaattataagaactgaaaataggtcagtggttgccaagggctggtatgagggagaggctgatttaataagcagatgagggaatattttgaggtgatagaactgttgtatgtcttagttgttgtggggtttacctgactatatatgttagttaaagctcatagaattggataattaaatggatgatattttggtatacaaaatctcaagaaatgaaacttaaaatagaaaaaacaattaaaataacaatttttagaaataaaaaataatgaaatataccaaaagggaagcaaagaatgatgaatacaagatttaggatcatggttatattagatgggacaggcagggacatgggtgaaggctgaattacacaggtgcatataatttactatcaaagttatcattttcgcttggatggtgaatttttgtgtgtttgttatttaaataatagacaaacaggtaggcacattaattaagaaggccaagcatggatgaattgtgagcatataatatgaacagagggtatttgttaatctaattttgtgcttctgaaatccaatagtaagaaaattaaatgacataaactccacgacaacttggacaacttcccaagttgccattgatggcttgctcatctcatcttccccaagaatgactcagctgcttttcatagcatcagtcatatattgcaaaggagaagggttgatccttggttggttgtttgtccactcatttattactaatatgacttctcagaagattcaccctggaactagacctcagataaagcacctcctggcccagagtcaacatgcttgttattaggtcataacatcctcattttgagccagtcaagtaaatttcttcttcattatcccaggtcctcaggatgtcagggatactaagaagttctcacagtgcagaacatttggagctgctccatgctctgagagaagtaactgggctgtggactgtgttctgagaagaacaagtggttggagatttcataagagatgtgtgagattaaggagttccatcccaagaagaaaaagaatgtctccaaattaggatatggagacagaaactcagaaagggacccagtggtggagctaagaaaaagccagctacaagtcagctttcaattcatgaggaaaggtggaccctcctgctgacaagttctgaaatgctttgagtcacactgacaggcggacatgtgttatactcaaaatgaagtcttacagcaattcaaagttgtacatcattaggagtaaatacggactctgtacttatttctggacaacgactgtacatggaaaagtaattattcacttctgaagctaggtttgaactccaagacaaagacagttctctcacccacactataatgcctacattttgcctttgggctcagtcatcacagatataaataccatatttgtgtagtgtctatcttctctgctaggttgtaagatccctgaagaaagtaaatgtgccccttattcagtgctgaaacccaagctgagcaagccacttactggccttagcagatattcagcttgtgtttctcaaataaaggatgatgagagtcaattccaacatgtaagattggtgatggcatgtcggaaagagagaggctcagatcaaactttgggcttgagaagaaaagttatagagtgatgtctccagtgagggttgcagatcaggggtcagggtagacccaacagggcatctgggactctctgggagcaccctctcactcctctcactcaggctgccccattcctgttctctaggttttaggtctgacaccactggcattttttccgatattttttttccactctcttggttgcttttcagcctcaccatccagtttgacataaaaaagcacattgcacctgttatgggacagtcactagaagagctaatggctgctctcagtgcagcagttaagctgaaaatgcaaatacacctagaaacccggaagggaatgaggatcttatgttgaagaccgagaggacttttgtatatggggtgagataagggtccagtttcattcttctgcatgtgaatatctagttttccccaaaccatttatttaagaaactatcctttttccattgtgtgttcttggcacctttgtcaaagatcagttaacaggaagtgtgtgtgtgggttaatttatgggctctctagctctctattctgttccattgatctatgtgtctgtcttttttttttcatgctgttttgattactggagctttgtagtacatttgaaatcaagtggtgtattacgtccagctttgttcttttgtccttaagattgctttggctattcagggtattttgtagttccacatgaattttaggatttaaaaaaaattctattttatttttcaagatggtatattggaggctttagcatgactcttccacttggaaatagcaaaataatgcataaagatcaaaattatggctttaattcaagaacgaaaatgggaattcactggaaagcaaaagacatcacagttcctaaggaggcgaaaatgggcaaacaacccttgttatagagtccagctgaaaagtgagtgaagccccaatatgtgagaggggcacacattatgacttagctttctaatggggatccatgcaacccaggccaaaggagagcatcatatttctcccatgccctggagctagcttgagaagaggttgggagacactgagagggaaagacactgggaaaagctgcggagattttcccgaacccagtactgaaagcaggatgccatttttaatccaggcacatacaaagtcagccattctctgatgacttggcagtatggctgtgcaggcattttagtcttgggccagagagtggagcacttaccctggagtagggtaggggtctctacagccataatctaatggcaagtgtggaaagtgccccacaagtaggtgctggaactgtgttctcccctatcaccgcagtaggagaactactgcagctgctgtttcttctgggtggtaagacttgcagccagggccacctggtgtggagacccggaattagtctgtatgtgtcattcatgggtgctccagcctgctcccctgagactgtgctgcagcagggcaatttctgctccatgctcccacagatcttcagacattcaggactccacttgtctggatcagcagcctgagctgccccattcttccagtgcagattgtggtaaagcagggccctctatgctttatgcctaggcagatattcaggcatctggagcacccactctcctggattaggagttcaagctgccccccaacacttccatgcagagaacttggggccaaggaggtttcccagctccaggcctaggcaccccactgggagcctttctcccttggtgctggtgcttgtgcctgccattggaggatctgttaggtgggctgcccagtgtggctctacccatctttgtatgcccccaaggactgagcagggagctcaaaccactgagcaccccacagatcagcccattgcctgaggcaattcagagcttctgtccgtaaacaagtatcaaatatatacctatttgcattgaccactgctggcttttactcataagcaccatctactggcctgtaggtcaaactgatcagcccaaaataaaacctgccaatagaagtgcctagggcatagggctacagaagtagtcaaaagaccctagccaacattttctacagtcacaccttctagggaggaagggggaaggaaaaaaaaaaaaagaacaaatcaataaaattatagggaaataaataaagaaaaaatcttatccacatgaaaatatttacatagaagtgctaggctagcatcaccagatgagaaagaactagcacaaggactctggtaccatgaaaagtctgaatgttgtgacacctccaaaagatcttcagcaatggtccctaaccaaaatgaaatctcaggaattacatataacaaattcaaaacatgaattgcaacaaagcacaatgagatcgaagacaaggttgaaaatcaacataaagaaacttctaaagcaatgcagaaaataaaggaagagataaaaaatcttaaatcaatcagagattctgaatttaaaaactcacttaaagaaattcaaaatatgattgaaagctttaccactagactagaccaagcagaagaaagaatttcactggtatgaataccaatcttttgaactaatccagtcagacaagaataaagaaaaaagaatttaaaaaacgaacaaagtctttgaggaaggatattctgtaaagcaaccaaacctacaaattactggcatttccaagaaagaaggagaaagagtaaacaacctggaaagtatatttgagggaataactcaaggaaattcccctcatcttgctaaagaggtagacattaagacacaagaaatatagagaatgtgtgcaagatactatacaaaacaaacatcaccaaggcagatagtcaccagactgtccaagattaatgctaaagaaaaaaatcttaaaggcagctagagaaaaaggtcagaccacatacaaagggaagcccatcaggctaactgcagagttctcagcagaaaacatacaaatcagaagacattgggggctcattttcagcatccttaaagaaaagaaattccaaccaagaatttaatcccctatcaaactatgcttcataagcaaagaagaaataaaatcttttccagaccaatgattactaagggaatttgttaccactagactaaccttacaagaaatctttaaaggagttctaaacatggaaacaaaagaacaatacctggtccacaaaaacacagttaagtacatagcttgcagaccccatgaagcagctacacaatagaaactacaaagcagccagctcacaacttcacaatcaaaacttcacatatcaatatgtgggcttgagtataaatggtctgcaggcccaatttaaatggcacagaatggcaggtaggatgaaaaagcaagacttatccatctgatgtcttcaagagacccatctcaaatgtagcgacaattataagctcaaaggggttggaaaaggatctatcatgcaaatggaaaacaaaacaaagtgggagtcaatattcttagataaaatagactttaaatcaacaaaaactaagagaaaaaccaaagaaggcaattacataaaaataatgcattcaattaaacaataagatttgactatcctaaatatatatgcattcaacattggggcactccagttcataaaacaagtacttctaggtatatgaaaagaacttagccacacaatgatagtgaggacttcaacactccattggcagtgttagacacatcatcgaggcagaaaactaacaaattctggacttaaattggacacttgatgaattgggttaacaaacttctacagagtacttcacccattaatcacaaaataaattcttctcacctgcacatggaacatactccaagattaaccacatgctcagccataaggtgagtctcaataaatttaaaaaaattgaaatcatacaatttatacttttggaccacagtggaataaaaacaaaagtcaatactaaggagatgtctcaaaaccaaacaattacatggaaattaaacagcttgtttctggatgaatttgggggaaacaacaaaattaaggcagacataaaaaattctttgaaataaatgaaaacagagataaaacatccaaaaagttaacaacctaacatcactcctagaggaactagggaaatgagaaaaattaacccaaagttagaagaaaagaaataactaaaatcagagcaaaactgaatgaaattaagatccaaaaccacacaacttcccaagactaaatcaggaagaaactgaaaacttgaccagaccaacatggagctccaaaatggaattagtaattaagaaaccgtaccaaccaaaaaaagccctagaccagatggattcatagctgaattctaccagaggtacaaagaatagctggtacccattctactaaaactattccaaaaaattgaggaggaaggactcctccctaactcattctatgagtccagcatcattctgatactaaaaatctgggaaagatagaatgaaaaagaaaaatataggtcaatatctcagatgaacagacacaaaaatcctcaacaaaatactagcaagctgaatccagcagcacaccagaaagttaattaaccacaatcgagtaggccttattcctggcatgtaggtttggttcaacatatgcaaatcaatataagtgattcacctcataaacagaattaaaaacaaaaaccttatgattgtctcaatagtgcagaaaaatcttttgataaaatctaacatcctgtcataaaaaccctccacaaactaggcattgaaggaacatacctcaaaataataagagccatttatgacgaactcacaatcaacatcatacagaatgtgtagaatctggaagcattccccttaagaacatgaagacaaataggctccttctcaccactcctattaaatctagtagtggaaattctagtcagagcaatcaggcaaaagaaagaaataaaagacatccaaataggaaaagagtaagtcaaattatctcttttctctgattctgtacctagaaaaccctaaagactctgccctaagtttcctagaactgataagcaacttcagtaaagtttcaggatacaaaatcaacacacaaaaataagtagcacttctactcaccaattacgttcaaactaagagccaaataaagaatgcaatccatttacaatagacccccaaaaatacctaggcatacatctaaccaagatggtgaaagatctctataaggaagactaaaaatcactactgaaagaaatcgtagatgacacaaacaaatcggaaaacattccatgctcttggattggaagaatcaatgtcgttataatgaccatatcgcctgaaacaatctacagattcaacactattcctatcaaactaccaatataatttttcatggaattttgataaaaactactctatattcaatatggaaccaaaaatgagccaaaatagccaaggcaattctaagcaaaaagaacaaatttggaagcatcatattacccaacttaaaccatactgtaaggccactaaccaaaacagcatggtactggtacaaaaacagacatatagaccaaaagaacagacagattacctagaaataaagcaatacctctatagccagctgatttttgacaaagtcaacaaaaataagcaatagggaaaggattccctattcaataaattatgctgggataactggctatccatatgtggaagaatgaatctggacccctaccattcatcatatacaaaaattaactcaaggtgaattaaaaatgtaaatgtaagacctcaaactataaaaattctggaagaaagccaaagaaatacaattctgaacatcagccttggcaaagaatttatgattaagtccccaaaggcaattgcaacaacaagaaaagtcaagtgggacctaattaaactaaagagcttctgcacagcaaatgaaaccatcgcagagtaaacagacaacctacagaataggagaaaatattcataaactatgcatacaacacagttctaatatccagaatctttaaggaatttaaacaattcgacaggcaaaaaaaccccacaaataaccccattaaaaagtgggcaaaggacatgaacagacacttctcaaaagaaggcatataagcggccaataaacatactcaatatcactaatcatcagagaaatgcaaatcaaaaccacatgagatactgtctcacaccagttagaatggctattattaaaaagtcaaaaaataacagatattggcaaggttgtgcagaaaaggaaatgcttgtacactgctggtgggaatgtaaattagttcagccactgtggaaagcggtttggagatttctcagagaacttaaaacagaaatgctattcgacctggcaatctcattactgggtatatatccaaaggaaaataaactgttctaccaataataatagtaataataataacctatacactcttaaattcatcacagcacaattcacaatagcaaagacatggaatcagcctagatgcccatcaacagtggattggaaaattataacgtggtacatatacaccatggaatattacacagccatagaaaagaatgaaatcacgtcttttgcagcagtgtagatccaactggatgccattatcctaagaaaattaatgcaggaacagaaaaccaaatacttcatgttctcacttataagtgggagctaaatactggatacacataaacataatgatggcaacaatagacactagacaactagaaggggagagaggaaaggatgcaaggagtggaaaactactattgggtatatgctcactacctgagtgatgggatcatttgtacccaaaccttaacattgtgtaacatactaatataaacaatctgctcgtgtacacctgaatctaaaataaaagttgaaactgtaaaaacaacatcaaaaaattctgtcagaatgtcattggaattttgatagacattgcagtaaatctgtagattgctttggggaatatggacaatttattcatttatttattttaatgtatattatttttaattgacaaactagaattgtattacatttattgagtacaatgtaatgttttgacattttgtgtagtgatatatttgaaatttgctctctctattttgaactaagccatacataattattgactgtattcactctcctgtgcgatagatcttaaaacatatccctgctgtctagctaaaaattttaagtttttgattaacaaatccccaagtcctttgctgccctctccctctagcctctgttaactaccattatactgtctgcttctatgaattcagctatttttagattctataaataagtgagatcatgcattgtctttccatatctggcttatttcacttagtgtaatgtcctttaggttcatccatgttgtcacaaatgacgggatttccttattttataaggctgagtagtagtctattgtgtacgtatactacattttctttctccattgatagacacaggtttattccatatcttagatactgtaattaatgctgtaataaatatgggaatgtagatatccctttgatacaacgatttcaatgccttggatatattttcagaagtaagattgctgaatcatattttagttctatttttagttttttcaggaacatccatatcattttgtataatgtttattataatttacattcccaccaacagtgtacaagtgttcccttttctctgcattctcaccaacacttttcttttctttttttctttttttagatatataagccattctaacaggtgtgagttgttatcttactgtggttttaatttgcattttcctgataattagtgatgctgagttttttttttttcctaaacccgttggtcatccctaggtctttgtttgagaagtgtctgttaaagttctttccccatgttcaaattttttttcttgctactgagttgagttcattacatattttggatattaaccctttatcagatatatggtttgcaaattttttttccactctgtgggttgtctgttcactttgttaattggttctttggctgtgcagaaggtttttagtttaactaacaaaagcaatccaatttttctatttttgctttcgttgcctgagctttcagggtcatattcaaaaaattattgccccgagcaatgtcatggagctttccccctatgttttcttctaatagttttaaagtttcaggtattatgtttatgtctttaatccattttgagtttatttttgtgtatgctgcaaaataaaggtctaatttcacttttatgcatgataaccagttttcccagcactacttattgaagagactgtcctttacccattgtgtgttcttggtacctttgtcaaaagtcaatcgactgtgaacgcttaggtttattccctggctttctactaaattgttccatttgtctatgtgtctgtttttatgcaagcactgtgctgtttttactactgtagctttgtagtagatttcaaaaataggtcaggtgatatccccagctttgttatttttgttcaagattgccttgaactgtttgtggtcttttgtgctttcacgtgaatttaaagattatttttggcctggcgtggtggctcacacctgtaatcccagcactttgggaggccgagacgggcggatcacgaggtcaggcgatcgagaccatcgtggctaacacggtgaaaccccgtctctactaaacatacgaaaaaattagctgggcgtagtggcgggcgcctgtagtcccagctactcgggatgctgaggcaggagaatggcgtgaaacctggaggcggagcttgcagtgagccgagatcgcgccactgcactccagcctgggcgacagagcgagactccgtctcaaaaaaaaaaaaaaaaaaaaaagtttttttttctatttctgtgaaaatggcaatggaattttgatgtaagttgtattgcatctacagatcacttcgagtaatatgaacattttaacaatgttaactttttcaaaccatgaacatatttttatatgtgttttcttaaatttatttgattagtgttttaatagtctttagtatacacgtttttcacctccttagttaaatttacacctaagtattttattttctttttttgctgatgtaagtgggattgtttccttagttttctgcttggataactcattattagtgtatagaacactacttattttcatatgttgattttgtgtcctgcaactttactgaatttatcagttctaacaagtttttggtggactctttagaattttctttatatgagattatattgtcagcaaatagaaacactttcattaattccttttgtcttaggattccttttatttctttctcttgcctagttgctctggttaggacttccagaactatgttgtaaagaattgtgagagtgggcctccttcttttattcctaatcttagagaaaaagctttcaacttttcatgattaagtacgatgtttgctataggtttgtcagatatggcttttattgttttgaggtacatttcctttatacctattctattgagagtttttatcatgaaaggatattgagttttgtcatatgctttttctgcatctaatgagttgattacatggtttttattcttcattttattagtggaatgagtcacatatattcatttgtattttttgaaccatcctcgcagccctgggtaaatcccatttgatcagggcagatgattcgtttaacatgcggttgcatttggtttgctagcagtttggtaaggatttttgcgtttaggtttatcaaaggcattggcctgcaattttcttttctcggagtgtccttgtctggatttggtatcagagtaatgttggtcttgtaaaatgagtttgaaagtattccttcttcttcaatattttggaagagtttcagaaggattggtatacaatcttctttaagagattggtagaatttatttctaaagccacccagtcctgggcgtttctttgataggagactgttactgatttaatcccttatttattgctgatttaatccctttactcactattggtctgttaaggttttctattcatgagtcagttttgttaggttctatgtgtttaggaatttataaatttcttctagatatccaattatctggcctacagttgttataatcatttgtatttctgtggcatcagttataatgtgtccactttcatttctgatttttatttctttgagccttctttctttttttcttagttagtctagctaaggtttgttgattttgtttatctttaaaaaaataattatttgtttcattaattttttctactgttttcctaggctctattttatttatttctgcttggatctttgtcattcctttccttctcttaactttgggcttagtttgttcttctttttctagttccttgagatgtaacattacattgtttatttgagatcttttgtctttttgatatagacatttattgttattattttccctcttagcactgcttttgctgcatcccacaaaatttgttttgttgtgttttcatttttgtttatctcaaggcattttttgattttctttttttatttcttctgtgacccattggtttttaagagcatcttgcttgattttcacatattttaaaattttataaggtttctcctgttacagatttctagtttgatgtcattggttggttggtatagttttaatcttccgagatttgttaagaattgttttgtggcctaacatacagtctattttagagaatattctatgtgctcctgagaagaaagtatattctgttgctgtttggtggaatgttttgtatgtgtctgttagttctctttggtctgaggtgtaattcaagcctagtgttcccttattaactttctgcttagatgagctgtctattgttgaaagtagagtattgagatttcctgttgttatggtattgcagtctatcattcccttcagaaaatttaataattgcattggtatatatgtgctcttatgttgggtgcatatatatttacaattatattcttttgatggcttagcactttctattgccgtaaaatgacctactctgtcttttttatagtttttgacttaaagtatattttatatgctataagtatagctaccatgctctctttgtttccatttttatgaagtatcttttcccatcccttcatgttcagtctatgtatgtccttagaaggaaagtgagtctcttgtaggcagcatatggtttgatctttaaaaaaatctattgagctcctctgtcttttgattagataacttaatcctgttacagtcaagacaatttttgatagtttaaacttactaccattattttcttaattgttttctggttgttttcttgatcttttgtttctttcttaatttcttgttctcttcctttgtggcttatagttttctgtggtggtcttctttgatttttttttatattttgttctacaggattttgctttatggctaccatggggcttatataaaacatcctaaatttgaaacaggctattttaagctaataactttaattacaaacagaactgcacattaattccctccttccccttgtatacttttgatatttacctagttttataatttatatctcttaattatttattgtagctacagttatttttaatagttctttttttaatcctcataggacagataaaattgttttatgcttcacccttacagttttagaatattctgaatatgattacatagtcatattacttataccattgagatatttacttttgtgtttttgttattaattagcagattttcattttagcttgaagaactccctttagcaattcctatggagcaggcctagtgatgatgaattcccttagcttttgtttgtctgagaaagtttttatttctgcctaatttctgaagagcagactttccaggtaatgtatccttggttagcacttttttcttcagaattttgaatatctcattctactttctcatggcctgcagaatttctgccaggaaagctgttaacagctgtattgggactgctttgaatgtgatgtttcttatctcttggtgttttttttttgtcttgcatttttgataattttattctagaattttttgataattttattctagaattaatgtttgggttgaatttacttggagacttatgagcttcctatacctgaatgctgtcatctttcttcagattttgaaaatttttagtcattattaccttaaatgtgctttctgggcctttgtctctctcttcttcttcttcagaaactcctattatgtggaggttaattctcttaatagtgtcccataatttctgtaggtcttttccattcttttttctttttactcctctaactggataatttcaaatatcctatcttcaagttattctttcttccacttgatcaagtctgctgttgaagctttctattgaattttatagttctgttattacatactttatctctaggatttctatttttattgtttctatttatttggcaatctcctcattttgttttataaattgttttccacatttaatttagttttttatctgtatttacttgtagtcccctataagtaatacgactatgtatcatattcagaatattctaaagctgtaacagtgaagtataaaaaagctttatctttcctgtgaagattaaaaagacacaactattaaaaataactgtaggtacaataaattattaacggatacattttacaaaactaggtgaattttttttttttttttttgagatagagtcttgctccgtcacccaggctggagtgcagtggaatgatctcggctcactgcaacctctgtctcccaggctcaagcaattctcctgcctcaacctcccaaatagctgggactacaggtgcatgctgccacacacgactaattttttgttttttagtagagacggggtttcaccgcgtttaagataattgttctgaattcttcatcagtcattttataaatcttcacttcttcaggatcccttattggagatttattaatttccttatgatgatgatgtattttttcagatttttcataatccttgtgtccttgcattggtgcccaaccatttgaggaaatggccaactattccgcctttgtttgtgttatttggccatggtataccttcactatttgatcaaacctggaattctgattaagcaagttggtggtgaccttgaacgggaagaccttgctgtcatgctctctagctgggctgaactgttaactgtactggttgagtagaatttctggctctgttccatggtctggtgagagaactggctggactctgtaataagacagagctgctggctgaaattgcctctgattgagcagtattgttggttgtcttccttagatggccagtactacagttttgaatatgtagttgggcaaggccatgttttaggtgtcaaggctgaacaaagactctgagattgctacctaaccatgcagggtgacaggaccagaggctgtgctccacagatacacatgggcatgggttcagctctaatcctgggatgacctaaggcagagcaccatggcttgatatattagccacttggatgctgggcctgggtggaacagatgctccttctacagttaattgccaccatgcccctgttttctggccttaggaagcgttaaggagcacaaagggcagggcttgactgggtgaaagcttggcagctgggaatggttggggccagatgttctctttgcaggtaattgccattctacccttatctcctggcctggggaagtttcaaggggagcactggggctgagtgtggaagctgagcagagattcaaacctggcagactaatcaactgtgcttcttgttgagcattgcaagcctctctggtggtgtgcctctgctggccagaatgcagagcaactatcaagacccctgaactggtcactgtgagtctcaccctgttctgagtttctaaataaacattgctaatgtttcctgtgggataagacaagagagtttcttctgcgaaggattccaaaatggtgggaaagctgaatgttcattctcaactctctcttccctctgtaaaagccatgggttctgggaatcctcttatgtgtgatgtgctggcttgagggagggacagtgtggtcaaagtaaaacctcctcttgctctacgtgtgtggtttttctcagtactgtggtccaaggggatgtctgtgcctcacttcaagttctgagatattcacaagggtatccttgtctgctgttggttgctagttggatttctgtggtgggactactggagtcagagaattcctattctattatatttctaacatctcccctagtatgaacattttagcaacattcacttttccagtctgtgaacatgtaatatctttctatttgtgtcttcattttctttcctcaatgttttatagtttttagtatacagatctttcacttctttggtaaaatttattcctaagtattttttggatgatattataaatgggatttttaacttctttttttggatagttgttatggtatgtgtaagtgctactgatttctgtacgttgattttgtattaaagtcttaaacataagacctgaaattttaaaactactggagtaaaacacagggggaaaacttcttgacattagacctgggcaaatattatttttgaattttgaccctaaaagtacaggcaacaaaataaaaaatagacaaatgtggttgcatcaaagtaaaaagcttctgcaaaataaagcaaacagttaatggagtgaagagacaacatacagtatgtgataaaatatctgtgaactacacatctgataaggagttaatattcaaaatattttagaaactcaaacaactcagtagcaagaaaacacataaaccaatcaaaaaagtgggcacagggagtttcccaaaagaagccatacaaatggcctacagtatatataaaaatgtgctcaacatcgctaataatcagggaaatgcaagttaaaaacacaatatcacctcacatctgctagaatggctattatcaaaagacaagaaataacaagtattggcaaagatttggagaaaagggaacctttttacagtattagtgggaaagtaaagtagtatggccattgtggaaaacagtgtgaagtttccttaaaaaattaaaaatgaaactactatgtgattcaacaatcccactactgggtatatagctaaaggaaatgaaatcagtattttgaagagatatctgcactcccaaatttattgcagcattgtttactacagtcaagatatagaatcaacctaagtgtcctttagtgggtaaatggattaaaaaacatgttatataagtgtaatggaatacaactcagccttatataaaaagggaagtttctaatttgtgacaacatgtataaacctgaaagatattatgctaagtaaaataagccagatatagaaagacaaatattcgtgatctcacttttatgtggaatcctaaaaagtcgagtgcgtggaagtagaaatgatcattatcaggggttgggttggggagtggggaagaactggggagatgttggtcaaaggatacaaaatttcaataagaccggagtaataaattcaggagatttattgtacagcatgatgactataacaatgtattgtatttttgaaaatttctaaaagagtagactttgagtggtcttattacaaaaaatggtaagtgtgtccagctgtcattcctggagaacacctgaaaaccatcaccctttgggaccatcagtgcaatagaggactgacttacaaaggctgtggtcttaggcttgaagtctttttaaacacttctgtgatagtgcttattctgtcagatcaaatatatttacttttctgagtgatagtccatttaggctgtaaggtgctcaatggaagaaatatgtccgatacatctccatactactactgttgaaagaagtaaaacgaacagagcttggaatgaacaagcagaggtgggcaggaggtacagggtggaccagagtgggaagtacttctgcagtcacgaggacatcctgcttccatcttattaaatctttaggcatgtgcccaggaagacacaggggtcatcttattacacctttaggcacatgctgaggcagcaggcaactgggaagtgtctggtgctgtcacctccctggttgtgaaaacagcagcatactcaggttgtgcatcatcgtgtacactgcacgggataaaagggctcctaccctgggcttctcatccacagcatccttaggagcagccttcttctcctacctcctctgcatctggtgagtggccagcaggggacagatcctcagctgggagtgtttgggaaagagaggcccagaactgaaatggaaccatcagaaagaagcccacagtgggcagcagtgggggaggtgatggagaataaggagcctctaaagcacatgtcagggacccgtgagctgcaaaacccgcaggaccttaggattccttcacattcttgtttggagcatgttgtcaggaatgcacatagatccattttatatttttaaggttgctttatccaaatgcatgtgtagggttccctctactacattcccatttctctcctacagatcttggcttagaaagtggcttcatcaagggggtcagtgtgtgacaaacccaaaaataaggagatggtctgagggttctgtgctcaaatgtttctattattctgttcaaggtaaaattcctgcattcctgcaaagatgtcctgccagcaaaaccagcagcagtgccagccccctcccagttgtccctcacccaagtgtcccccaaagagcccagcacagtgtctgcctccaccctcttctgactgtgctctaagctccgggggctgtggccccagttctgaaagtggctgctgcctgagccaccacaggcacttcaggtcccatcaatgccggcgccagagatccaactcctgtgacaggggcagtggtcagcaaggcgggggctcctgccgtggccatggctctgggggctgctgctgacctggatcctgatgatgagacaagtgatctttggaggaaacaaggatcccaaaggcccaggaaaagctccatcctgatgcatgcttttccagataccttgttctggctttcacaagctgagctgggggtgttcctgttgagtatccaagctgtccccagaaggtgcttcctgtctggtgtataggatctcacagttccctcatccctgcccctgccaaggattggcagttccctgtgcctaaccctgccaaaaaataaagcttcttgttctcattaccacggtgtctcacttgttaggaaactatccaggatttatccatccaggccaggttctcctgtcacccgaactcgcaggaccttagaaagccagagatttaagtgtgttacccctggtagaggtgaccccagagagctgacctcatgctcgggcaagtaactgggctgtgttctcccagccaaccctctgtcatcacaggacacctgctcagcctcagacctgtgtagtttttgctctgatgacaaacagaggagcgaggaattgggagcccctcatggaggggaggaaaggttgatgggcaccatcaccaggatgggtatggagcctcccaagccaggcatcagggttggggctgtggagaaactcatttgtggacatctgctgcattccataggaacagaaagggccccccattacagttctggggtgttctgaaacttcagaacttactcctctgttgttgtatcccaatgactacagattttactcctaagaagcaaaagtggtcactcagctatattcagccccacaatctggctaccatgagaaagtgcttggtctatctcttttaaatgtctctttgcaggacagaggccactgaagggacccttaacattaagagtaaagtggccacccaagagtagttcaagggataattcctgaaaatacttccaagacagagacaggggtcatgtgctggaggcaggaaaatgctgctgagaatatcaatacctaaacctaccctctccccagtccacattcagagccaccctctttcctacggcccagtgcctttatgctcccacaggcatcactatttcagtttgctagggtgggctgtcaggcagaataagaagacaaaaattataaccccaatagtgaacataatttaatttttgttgacaattataatttaatttaaatatgtataaagtttgattacagcctgactgatttatcttgaaaaatatctagaaaaaggtacttattttaatattagagattaattgaatgagaaatttatctacaattaaaatgaaattcgcagagaaaatagcattcagtttgcatcaattctccgtacccaaaatatagacatgatcaggtcagctccattacatgagatgcacccagcactaccatcaacctcaaaagcagcaacacataccaaagtcatcttcatcaagcccatccattatcatgcatgcttgcagaacttcatttcgagtccaagcagatgaacgactcctccctctgtgttttcatggtcttcaaataaagagcacacattccctggattttgatggaaggtcatgccttttgtaatgtgcttactgtgactcttggcactccaattgttgtactttccttctccatatttgcccctcaatcaggtattcatttggctcccctcctctcctgcccaggggcctatgttacctcctgggtaccagtgaggctctttcaagagtcctcatctccgctgactttacccttccatctgttttacacacagcccattctgaatgtccagcatccttacctcagtcaccaccccaacagcaagtgctgatcacatctgatgcttgattttcctaagggaacattacagaaaaaagtagatgggcaaagaaccatggacttcgtgggtagtcatttacattgcagtacttatctcatggaagcagtctccctatttacttgactgcctgtgcagttagacagttaatttctataggtcaggtgatgtgtcatattgaactctaccttccaccacaatgcatggagcatgacatattttaagcacacatgtaggcctgggtggaaggtgtacaagtgaggaccagggcttcctgtgtcaaacatgccaccctgttcctgggaagacggtgaaggcctggacctgggctgggttgtttggtgctgtcacctccccgagcaacccattcatgctgcccctcacaatctagcagctctgtcttgggcttcccagaccatggacttctttcgaataagctttctcttgctgccatgaaaccagatggatgtctagctggagacaggacctgagctggaagacctaggaagacaagcccgggtttcttccatcaggggagaaggaagcagagggtatgggatggaggaagcaggaagagtgtggggttaatgggcaccctcccgggatgtatcaggtgtcctgtgactgcgaaggtcatgggtcttcagcacaccctcatcttcttcctatatatgttctgagagatgcactgatctcaccagacatcatcaaggaagctttacccaaacaggtttattctcctctgtgattacatgaagataggacacctcagctgctcaattagaaaagacccagtatcattttgtagcaggtgaccaaagagaaaagaacatctttccaggataaactaactccaaatttattttcatttcctccctatatttcttttcttttcttttctttttttttgagacggagtctcgctctgtcacccaggctggagtgcagtggcgtgatctcggctcactgccagctctgcctcccaggttcacgccattctcctgcctcagcctcccgagtagctgggactacaggtgcccgccaccacgctgtactaattttttgtatttttagtagagacggggtttcaccatattagccaggatggactcgatctcctgacctggtgatccgcctgcctcggcctcccaaagtgctgggattacaggcgtgagccatggcccctggtcctcctccctatatttcttagtgcagaagtacacccatcagagaagagatattacaaagattcatttgcattattgcattctctctagagtcattgatgctttctgagattttgtgtcagcaaaacgcgcagcagggatagcctccaaaggctcccagagttccccacccagtctgagccccatgtctagtctaccttcagtcttctcctgctatggctccagctccaggggttgctttaactcttagggggcagctgcagcctgggctaccacaggtgctatctcttccactggcacaggcactagagacatgactgctgtgagtttacccactggcagctgcagctgttgccagagctttgggcactgctgctgacctgggcagtgcattgagataagcagttttagaggaatcagagacccaaagtgcccaggattaacctcagtctgatgtacctgctcctaacctcctgcccatggtcggagctcctgagttcatcctgacaagggttgtcagtgatctccagtggtctccctggtgtccctcatggttgtctccacatccatgttctggtcagtgcttagcagcacttatgtctcactctgtaaaaaataaagctttcctttctcacctacgtttctatattgcccctccgaaggctgctccattgctctcccatgccttatctcccagactgaatgcttcacaggatgagaggaatgagagacaacacttctctctactcatagggagaccatgagttgctgctaggaagaggctacagaaggccacatggctgcagggaggaaagttcaccttatttctatatggaagatctgggtgttgaggaggtaggaagggatccttgaaagctgaatagttgatgggtgcaaggagagaaatgtagatggttgcagaggtatacactgagaggaacttagaagaagtaagaaaataaaaacctgatcattgcaggagttgtaaactggatatattcatagggtcaatgatttgtatactactcatgatgtgccagtggcttgacatacagtaaataatttaatcctcactgcagtccttcaagttacgtacaacccttgtcccattttacagatgggaatcatcatggaatgagtgtccagggtctcccaacagctgccatgcaaaccttggcagttttgctgagaagcctatgctcctgatgactgtggtgttctaagttcttctaaaatgttttaagagatgtgagtaaacaatggatttgttttgtaattattttagtccacagtattttgttgtttgaattatacatcactaaaccaccaaaccatatgaatcacacttttaaggagttcgcctcccagagtttggacccagagtgtagtattcagctgcaccacaggattaaaatcattatttttgatgtgcattaaaacaacaattcactttcactaccaattttgagaatgttaatgaactggagaaagactcagtaaaaattcaagccttggtgctcatcagtaaaatactagcaatccaaggaggtctcataaactctgagccaaagtgaaagagcagatcttaagagtagtttagggctagatacaacagagaaattaatgtatccagtaataggtgaatatattaaattttagaagctttttttccaagctcttgggaaatagggaaaagaaaattactcccctcttctgtgttcatagacattcattttcttaactcattgggatgaaaaaggtacccaaagggatcctatgaggaagttgatgtcagaactgctctgatgagtttagatcgactgcccagctcaattcctcttagttgccatgcctgggtttattgcccttggatggatacaggctccacatcttactcatcccatcaaccatcccaggtgacagcaggtgacaccatctggattcatcatttactctggctggattcatcatttactgattcaactagctaagaaagatttgtttaagaagttaccacagctgtaggacttataaaagcctatgatacagacttttgattcactacgacaaccacttgctactcaaaaattgagaaactcttgaataaaatcagcccaggcgacataaagaatgttgtgttatgacttctagaccaagtccaacacccaatcattcataatttatctgctcaacacgtagttttgtggcactggtctaggtgtttagatcagtgtgaaacaagatgaagtcccctttcaggcagcttatgttccagtgggcccattggagacatcttctggtttcctggcttgtcagcagatttagacaaagatggttctatattcagttggattcccactctggggcacttgacagatgccggtaaagggtggctaaacccagtgaaggcacccatcatgggcaaacttttgaaaactggatatcattttttgggtgaatacaaaaaggacatccaatgtctggttgtttccacatcaaaggtaggagcttagtgagtcaaggggtaggtgggtgattccaatggtgaaatgtttgtttaaaagttgaaaagtccttgtcccttcccagtgcctttctcacttcccagttctcagtgaacaaccccattcacccaagtatcttgaaagtgcttctgtttggtacttagctataatgtatggagcaaataaaaaaaatggccacacctatacccttccctgtatcaggatactcagacacatttaatgcaataataatgttttattaaaaccttgtcgttttaggatatgtttgaaacttacatgtgtattccatttttacatacttttaatatatcatgattcaggataaaatatatatctattattataataaatgcattggaaaaatactatagagtttagtgctctctctacaaccttggtccatgttgtgtcaggtgctcacggtgatcatattaacctcattataatcatacccatcaattatcatttctatttggacaaatctcttttagtcatcccatccaatttgaatcactctcttccctgggtctcttagaatcaatagtacagtcgctaagatcctgacacaaggttccttaaatgtatgttaatccatgatgcatattaccaaagccattgtggatttcttatacttgtctctgaatttacctgtgatatccctgggtcattttgcctccatgtaaacagatttgttttgcctcagacatctttaccttaatacagctattaggagaagcagggaaagattaaaacctagaagttcctgtctccaaaatggatgctcttaatgagcaaattattctgcattcaagactgtacatgtccccagtattcccctcagccctgttctacctcgacctcagcattgtctctttctcctgggcacctccttgatgtttcttgggtccacaaatttctcttagttgccatgcctcggtttactgcccttggatggatacaggctccacttctcattcatcccatcaacaatcccaagtgacagcaggtgacaccttttggattcatcatttattcagagtcgctacagaaccaaaagggactaatgccccaaaaccctgacttcaggcctggggactcccacacactgtatcccagcaccctctcctggctcaggcttagtttcctacttatctgtcagtctcactacaccatcagcctaagggtagggatggtatcttcttcagtcttgaatctgctttgcccagcacagtgagtgtcaccatctcaatataacttgtttaaagaaggaatgatgttaatgaatgaaaaatgaagaattgcagacctacagaaagactgaggcacaggtatgtgaatagtcacggggtttcttgaatccccactctcctcaaaactcttgacacctgccatggagatacagaggtcttggggctacagaggcaaagaagctgactcctaaacgagactcacattctcacccctcccaatcccaacacccatttcttgcctgcaaaagaaaatagaaaaagagctctaaggtttgctcagtcctcactggaatcaggatgcctcaacccaagttactttctatttcctgcactcctctgctcgggaatttttcctaagttgtggattcaaagccacatatgctttgaaataaacataaaaagatccaatttttgatcctgtttgagccatcacaggctttacacatcccacaaggcacagcatcagccctctggatgctgtcactcatgcagtgaccagggcactgaaaaccacagtggagcagggctggatgatccagtgaagcaaagagagaagcctcttcccagtgtggtgattttcctcctccctcacctctgctcctccttggtggagaagtcccgtggaacattagtgaagataataagggtgggaatgcccttgtagaaattactgttaatagtctgagaattgggcaggtactataaatcctaatcttttgtgtttcaaagccatttgcatcaacaagtgtttggtttcgaactcagcgtatccttgtcttagtaatcccttcttaggtcttattaccagaaagatcctcactcaacagaatgcccaggtgcagttccagtcagaacactcttgtggtgcccactcccaattttctctgtcaaacgtcattgagctctttcaatgcttcctttcacttttcccccaaccactctgctgcagttttgcatcccacagtgaacaagcttgtgtccattccaagccccctggagatgagacctccctcagagccaaagtatattcattgagcagagtatctgtcactaaagtgatgcagctgcctgggacctagcacagacccttcatgcccctaatatgtccattcctctccctacattcaggataggcagaatgttgaaagaaaacatggtaaaagataactgtagcaaagaattggcaaaagagatggcaggtgttgaagaaacggaatttgtcaagggtcatattggtcagggtcttctattgcctcccagagagttttcctttttccccatggactacaggtaagtagcacatgaatattctcaccatccaacacccaactccctgtcctccctcttgatcttctaagatactcctgttcatgaaagacttcctccctgaccttccaaactccatcatgtctccagtaactacccagtttctacttccagttgcctttacagtacctgtgtgtggtcattatgaagcttccaccaacattcctgaacttgcttctcgtttgtccttggggacctgaaatctgggcatttattgatttgattgatgctagaaagggtgggagaatccaaaactgcccctttcttataaaaacctaagagcctactaagttgtgtattgaacagtctaaagtcagtacaataaaaacatgaagcattgtctttttcggtcattgttttttcctatgctctgttgaatctctcttgaaaatacctcagggaaattccacatttcgtcagtcacttctatggatactaaagtccagaccagctaaatttaattctgaacaaaatttgaaactcaaattctcccttgcacacaagcattgtccaggtatctcccaggagactggagttggaaggggaatatgatgggctctttctctcattcactaccacccctccaccttcttcctcagtagcccttcctcctccattgtattgggagatggaaaaggggagggagaatcattacacatgtgactgtaccactagcctcctctgttggcaggttctgcggcagggctgtctctgcttcttctgtgtggcaggttctgcaggagggctgtcttatagggtgcttttgtgagtcctggagtatcttcaagcattttcctaacagcatgatttccagacatgggatgagcagtcggatttaacccttcacgtactccctaagctcctaccttcgttggcaccagccatggcttctcgataatgaggtctgtctgcccaacagaaaaccatcctaagcacaacactagcaagactgtggaagctggtcttccttcttagatgtcatctgctgttatgtctcaatgtcctgttctatctcttcagttccttttctttattcaacaataggctcagaggttagaacatcaagtctactactacagcagacattctgctgggggataaaaatgctgtctttctttcttgaaggaatctctaacatctacaggctgtcattgtgaatcctgccctttcaattgacctctgttgtaggagaacaaccagtttccctcccatgtacaagattagggggagactacatcattgtcttttaggataataactttcctatctaaaaaattctcaccaaagttcaaccttccaaatatatagctgaaccagagaaatagagttctatttttttttcttagcaagtcttgcagagattttcagcagcttatcctaagtttactttagtatatggggataagaggcatctactattttcatcttttgacttcagccaacatcgtaatacaagaagaaaatttgagtccaacatcttcttacacactgggtcctaccagagctttctcaggagaatagagcggtgtaaatatctcaaaatactatttaatctgagggaaaaattcaaatccatataagaaacttaggcacgttggaggtatatggcactttctggccactgcttcccattttccttaagaataacttagctgcttgccatggaatttgattgtcgcagacatggcaggaacagaatggagaaggaactgtgagttttaagcaaagggagaagaattctgtttgttgactcatccttgattgctgatgtggaatgtccaaaatgcactccaaggggctaaatctgaggtcctgcagtgcctgttcctatagtaccaattggaatgactaagtcatgaaatttttcctggattcatccagccagagcagtctctgtatttccttgatgtctttgggccacaggaagccaaggctcctcaggatgggactctcaggactagtgattctcagggaggtgcccttgtgctgtaggggaagtgacaagatcatgatcttatagctactgtttgtcatcacgggacaaatcctgtgcgtgtgagaactgtggacacctgatttcaggaagaggagagtggtgacaggagcaatcactaaggtagaagggagattaatgagctctccaggtcttgtggggaggctttcaagacaggcagtcaagaatggggctggaggaaagcctaacagtcatctattgtgttttataaaacagcggtaacacgatatattgaatgtcataggcaaggattttttttcctttgaaacttgcccaaaatgtgtgatttatgtttctttctcaattaacgcttccatctcctacctccctcagctgccaatgactcagggttgcaacccatgcaggaaaatggctatcatgcttgctctgttgggaggacaagacttgcttatgataaatacaagatacagagaaataaacgttcagatttgcagcaaagtctaaaccccagtaattttttaactgaatttttcaacagattgtgtccctcttcaacttcaccagtatggaatgagaaagtacccatttcaaccatcatgagtaattccttccaatgcactagcaatttgtgtgttctaaagaatgcaaaagaaatggacacctagtgtagtcccggggctaagcccaaaaatatcccttcagcaagaggcttctgcaggcagaagaatatcagagaggggagtcaatgacaggtctgatccttttcctcttcctccattcccaagccacattcctagagacaattcactttctcttaaatatctcaaaataaatcatggaattctgccccccacctcccaccatgttttaaagagggtaagttgtaaagtgcatactctgataaggagtttgttgtctaaaagccataaactatcaagtacagggagcaataacaggcatttaccataaacatgtgttatttaaaattaccatttaacttaaatttaatgttctgttatagttctgactttaactttttagaaacaaatagcaaagttcaggtattataataatagagatgaattcagtgaaaaattcatgtctaaaactattatacaatcaaatgggaaaaatacaaatcagactttatatgtcatcctacagaaaccttagaatttataaggtttgttccattaaatttgatgcacatgatgttactaccatcactaacctcatcatcaacaatacattgaacgaatcatgttcatgactcacaccaactatcttacatattttatgctcatggaccattttatttgcttataatcagtatcatatatcccatgggaagctaaatatgggcaaattgacctttttcatattaagtatgagtcttgtgatctcaactattgtatattccttaatgattttgtctgcttattcatataatcctaccttaattctcttaagggccccaacagccccagacagggcttgtgtcccattctccattcattacctaatacatctcactcccagggtccaatagtctcagatcacccaacatccccaagagtcaggagccaattacatctcaacaaaccatgcccctggggaatatgcagaggaatagggaagtgatgtccaaaaaaagacatcctgggatacccaggacgaatcacatgatatcatatcagacacataagtttacatctctgatgttagtccagttaactttgaaaggctcaaggtcaggaaatgtgtcatatgcatctttacattctccctcaaagtgcaagaggcagagctcaaactaaagcatccaaactgaatgagtgaaaggagaagaaatgacaggtccccaacacacgtggagatctgtcatcaagacttcctggttccctcttgccaggcatcttggcaagcatgaagcaagatgctggaggcctgggatgggagtgtttggctctgccacctccccttgttgtgaaagcagcatgcctggtctgtgcatctctaaccctgcacaagataaaaagcctcttatcttgggctcctcatccacagcctcctagagaacagccttctcctcttcagcatcttctgtatctggcaagtatctagcaggggaccctcagctgggggtgtctggggaagataagcccagattttactagggaagggggaagcagaggtgtcagatgtacagacagcaggaagaggacttcagagggcagctgagggtaggggaaggggcagtgagcaaggaacctctttggggtgcatgggagtctgtgactcaccagagccctggctctcagcattctctccactcttttcctgggagatgcatacatgcccagtgatattctctgagaatcattactcaattaggtgcttttgcatcagtgtttttgtgaagacaggaggacttgggacccagttagaagacaccagcattcttttctggaagagggaaaaatggaaggaaatgtcttaccaggccagttttacttgagatcagtttctgtttttattcctgaagtgcatatctcaggaagcaactggtattaggagtaagggcttcataaaaccatttgtagaggagacattagcctggagcttttgcgttgaccttttccttttatctatccaggctgtcacctcctgccaagatgtcctgccagcagaaccagcagcagtgccagcctctgcccaagtgcccctcacccaagtgccccccaaagagctcagcacagtgtctgcctccagcctcctcctgctgtgctccaagacctgggtgctgtggtggccccagctctgagggcggctgctgcctgagccaccacaggtgctgcaggtcccaccgatgccggcgccagagctccaactcctgtgacagaggcagtggtcagcaagatggtgcctccgactgtggctatggctctggaggctgctgctgacctaattcctgatgctgagacaagcgactttagaggaaacaagtatctcaaggaaaaaggaaaagccccaacttgttagatcctttcttagacatgctaattaaccattcattcatggggaagaattgtgctttttccaaaaggctccacccatgtgttttccaagatcgtggaagcctcctttcctcctgacaatgttatcacttgtgtctgattatacagagaaataaagcttctgaacagcacctgcatctaacttgtctttcactctgctccacagaaggctgctcagtgggtctcccctccctcagctcctgaaggtctagcacaccctgcatagagaataatactggcttgtggctggaaaattaaacgttcatatttttcttcatgcagggagtccctgtgggagatttgagtatagaagtgtaggagaaaggggaggtgttgagagaggttggtgaaaatctcttaaaaaaggcctaagatcagagcagaactgaaggaaatagagacacaaaaaacccttcaaaaaatcaatgaatccaggagctggtttttagaaaagatcaacaaaattggtagaccgctagcaagactaataaagaagaaaagagagaagaatcaaatagacacaataaaaaatgataaaggggatatcaccacagatcccacagaaatacaaactaccatcagagaatactataaacacctctacacaaataaactagaaaatctagaagaaatggatgaatttctggacacatacaccctcccaagactaaaccaggaagaagttgaatctctgaatagaccaataacagactctaaaattgaggcaataattaatagcttaccaacccaaaaaagtccaggaccagaaggattcacagccaaattctaccagaggtacaaggaggagctggtaccattccttctgaaactattccaatcaatagaaaaagagggaatcctccctaactcattttatgaggccagcatcatcctgataccaaagtctggcagagacacaacaacaacaacaaaaaagagaattttagaccaatatccctgatgaacatcgatgcaaaaatcctcaataaaatactggcaaaccaaacccagcagcacatcaaaaagcttatccaccatgatcaagtgggcttcatccctgggatgcaaggctggttcaacacacacaaatcaacaaacataatccagcatataaacagaaccaatgacaaaaaccatatgattatctcaatagatgcagaaaaggcctttgacaaaattcaacaatacttcatgctaaaaactctcaataaattaggtatcgatgggacgtatctcaaaataatctaagagctatctatgacaaacccacagccaatatcataccgaatgggcaaaaactggaagcattccctttgaaaactggcacaagacagagatgccctctctcaccactcctattcaacatagtgttggaagttctggccagggtaatcaggcaggagaaggaaataaagtgtattcaattagcaaaagagggagtcaaattgtccctgtttgcagatgacatgattgtatatctagaaaaccccattgtctcagcccaaaatctccttaagctgataggcaacttcagcaaagtctcaggatacaaaatcaatgtgcaaaaatcacaagcattcttatacaccaataacagacaaacacagagccaaatcatgagtgaactctcattcacaattgcttcgaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgtcatacccatcaagctaccaatgcctttcttcacagaattggaaaaaactactttaaaattcatatggaaccaaaaaagagccctcattgccaagtcaatcctaagccaaaagaacaaagctggaggcatcacgctacctgacttcaaactctactataaggctacagtaaccaaaacagcatggtactggtaccaaaacagaaatatagaccaatggaacagaacagagccctcagaaataatgctgcatatctacagctgtcagatctttgacaaacctgacaaaaacaagaaatggggaaaggattcccaaaactgctagccatatgtagaaagctgaaactggataccttccttataccttatacaaaaattaattcaagatggattaaagacttaaatcttaaacctaaaactataaaaaccctagaagaaaacctaggcaataccattcaggacataggcatgggcaaggacttcatgtctaaaacaccaaaagcaatggcaacaaaagccaaaattgacaaatggaatctaattaaactaaagtgcttctgcacagcaaaagaaactaccatcagagtgaacaggcaacctatagactggtagaaaatttttgcaatctactcatctgacaaagggctaatatccagaatctacaatgaactcaaacaaatttacaagaaaaaagcaaacaaccccatcaaaaagtgggcgaaggatatgaacagacacttctcaaaagaagacatttatgcagccaaaagacacatgaaaaaatgctcaacatcactggccatcagagaaatgtaaatcaaaaccacaatgagataccatctcacaccagttagaatggcaatcattaaaaagtcaggaaacaacaggtgctggagaggatgtggagaaatgggaacacttttacaatgttggtgggactgtaccattgtggaagtcagtgtggcgattcctcaggaatctagaactagaaataccatttgacccagccatcccattactgggtatatacccaaaggattataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctctgtagggacatggatgaagctggaaaccatcattctcagcaaactatcgcaaggacaaaaaaccaaacactgcatgttctcactcataggtgcgaattgaacaatgaggacacatggacacaggaaggggaacatcacacaccagggcctgttgtggggtgggggtaggggggagggatagcattacgagatatacctaatgttaaatgacgagttaatgggtgcacaccaacatggcacatgtatacatatgtaacaaacctgcatgttgtgcacatgtaccctaaaacttaaagtataattaaaaaaaataaaggcctgacttttcttggatgataccgtgggaggagtgatttgaccctgtagcccacagtttccattgacggtgatgtagagaatcagaaaatcgacaagaatgagaccaaagtggatggagcatgtggaggcagaaagaaaggtctgaaggatgaagatcaagtcaagctgcacataatggaccttagggagggaggttagctgaagtcagtggattctgaagcaattggaattgaagttttctctgacgggaatgctaatgagaggctctgtgctctgagaaaacagaaaaaagcggacatgatgaatgcttctgggggtacagattacatatctgtaaatttcttttaagatatttgagatagaattgaactcattattattttctgtc

SEQ ID NO: 274 - DNA, 33218 bp, Homo sapiens
attatgagaggacaatcacatttcagtcattcttttctgacagttagaggcctcactacaacccctctcatcacatcctgtcccccactgccgcacaattccagcagaaaaggactcgacagattcctgaattttgcagacctagagctagaattctgcatcttccctgtggtggtgctggatgtcaggggcagacaggagggcacacttccagccccacctagggagagacagagtgaaatgccaagggagacaccagtggtaatgaggacaaggagctttattttttgatgaggtcaggcacaagcactgccaatccttcacaggtacaggggtaagggaacatgtgacatcctggacatcagacaggaagtgccttctggggagagctcagaccttccacaggaaaacccctagctcagcctgtgaaagccagaagagggtatctgggaactcatgcatcaagatggggttttcctgggcccttgggattcttgtttcctccaaaatcgcttgtctcagcatcaggatccaggtcagcagcagcctccagagccatggccgcagccagagcccccgccttgctgaccactgcccctgtcacaggagttgggcctctggcgccggcatcggtggtggcgcctgtggtggttcaggaagcagccgccctcggagctagggccacagcccccagagcttggggcacagccagaggaagctggaggcagacactgtactgggctctttgggggacacttgggtgagggacacttgggtgggggttggcactgctgctggttctgctggcaggacatcttggcaggagttgagttgtcctggacaaaacaaagccatttgttagtccaaaatctacagtccaatgtctctaagaccagcggcctcctgaggcaagagctgcaggaaggtgagggaagctgatgtggagttggtgggacatgccagatgcctctcactttgttctccaccagggacagattgctgtgagtctaagtgggcatccatgtttctgtttctccaaagagcctctaggaatgtacccttttgacaaaaggcattctggagaatggagatcataggaaacatgtgccagcctgagtagaaagaggatgggaaggaatcataagcttctgtggcctttgcaggtcatggaattgctgtcagttcctgcagggtctccctcctggccccagttcccacattggtaccctctctgccatcctctctccgggcttttgtttcagatctctccatttccctctcctgctatgaccttagttttctgttccaacatcccaagttgagtcccatcccctgctggacactcaccaggtgcagaggaggcaggagaaggctgttcctgaggagacggtggatgaggagcccagggcaggagtgcttttatcttgtgcacggtgtgtgatgcacagcctgggcatgctgctgctttcacaaccaggggaggtgtcaacaaggcacacgcccaagactaggtttgtagctttggcacttccataatatccaaccaatgacattgaacctggaagcaggatcactgtccacatacctctcacctgggaggctaccactgcttcttttcttcctcccttcttccttgtttcaactcacgtgctgtggagcacagtctgtcctttacaatttcctgggaattagtatgacataattctttcttgagtcatgactggagaaataatagtcatttcaacaaatagagatgaaataattggacgtccatatgtaaaagaaatcatacctaatgctagatataaaaattaatagatcataatttaaaaaattaaactatgaaacttctgcaataaaacataataaatctttgtgactttgggttatgcaaaatttttcagatatgccaaaaaggtacaattcaaaaaagaaatataggacttcatcaaaattaaaaacttctgcttttcaaaaggcactgctaggcaaatgcaaagaaaattcacagacttggagacaatattgtaaaacacaaatcttaccaaggacttggttcaagaattttttttttatttttattttttgagacggagtcttgctctgtcgtccagactgaagtgcagtggcgcgatcttggctcactgcaagctctgcctcccgggttctcgccattctccctgctcagcctcccaagcagctgggtctacaggcgcctgccaccacacccagctaatttttttgtatttttagtagagatggggtttcactgtgttagccaggatggtctctatctcctgacctgtgatccacccgcctcggcctcccaaagtggtgggattacagagccactgtgcccggccaatgttttttaaattctcaaaaataggtaataacacagaaaatatgggcaaagtatttgaagagtcattttaacaaagaagatatatgggtggcagttaagcacatgaaaagatactcaacctaatcagtcattagagaaatgcaatttaaaagcaaagtgagataccactctatacacattggaatggctaaaatgaaataaatgacaatatcaagtaatatgagggatgtagaacaacaagaagcccaagtcattgctggtagaaatgcaaaattacattagttggcagtctatcaaaaaaattaaacatacaacttacaatttgccccagaaatcctattcttagatatttagccaaaagaaatatagttgtatgttcacagaaaaacctgtagcccaacatttatagtggctttattcataactgccctgaatttgaagaaccccacaagatcttcaactgatgaatagagttttaaaaatggtatatttatgcaatggaaggctacttagcaataaaaaaggaatcaactactgatatataaaacaacagggatgaatctcaaatgcaaaagaagtcagactttacatactacatattatataattttaattatagggcattcttgaaaaggcaaaattataagaactgaaaataggtcagtggttgccaagggctggtatgagggagaggctgatttaataagcagatgagggaatattttgaggtgatagaactgttgtatgtcttagttgttgtggggtttacctgactatatatgttagttaaagctcatagaattggataattaaatggatgatattttggtatacaaaatctcaagaaatgaaacttaaaatagaaaaaacaattaaaataacaatttttagaaataaaaaataatgaaatataccaaaagggaagcaaagaatgatgaatacaagatttaggatcatggttatattagatgggacaggcagggacatgggtgaaggctgaattacacaggtgcatataatttactatcaaagttatcattttcgcttggatggtgaatttttgtgtgtttgttatttaaataatagacaaacaggtaggcacattaattaagaaggccaagcatggatgaattgtgagcatataatatgaacagagggtatttgttaatctaattttgtgcttctgaaatccaatagtaagaaaattaaatgacataaactccacgacaacttggacaacttcccaagttgccattgatggcttgctcatctcatcttccccaagaatgactcagctgcttttcatagcatcagtcatatattgcaaaggagaagggttgatccttggttggttgtttgtccactcatttattactaatatgacttctcagaagattcaccctggaactagacctcagataaagcacctcctggcccagagtcaacatgcttgttattaggtcataacatcctcattttgagccagtcaagtaaatttcttcttcattatcccaggtcctcaggatgtcagggatactaagaagttctcacagtgcagaacatttggagctgctccatgctctgagagaagtaactgggctgtggactgtgttctgagaagaacaagtggttggagatttcataagagatgtgtgagattaaggagttccatcccaagaagaaaaagaatgtctccaaattaggatatggagacagaaactcagaaagggacccagtggtggagctaagaaaaagccagctacaagtcagctttcaattcatgaggaaaggtggaccctcctgctgacaagttctgaaatgctttgagtcacactgacaggcggacatgtgttatactcaaaatgaagtcttacagcaattcaaagttgtacatcattaggagtaaatacggactctgtacttatttctggacaacgactgtacatggaaaagtaattattcacttctgaagctaggtttgaactccaagacaaagacagttctctcacccacactataatgcctacattttgcctttgggctcagtcatcacagatataaataccatatttgtgtagtgtctatcttctctgctaggttgtaagatccctgaagaaagtaaatgtgccccttattcagtgctgaaacccaagctgagcaagccacttactggccttagcagatattcagcttgtgtttctcaaataaaggatgatgagagtcaattccaacatgtaagattggtgatggcatgtcggaaagagagaggctcagatcaaactttgggcttgagaagaaaagttatagagtgatgtctccagtgagggttgcagatcaggggtcagggtagacccaacagggcatctgggactctctgggagcaccctctcactcctctcactcaggctgccccattcctgttctctaggttttaggtctgacaccactggcattttttccgatattttttttccactctcttggttgcttttcagcctcaccatccagtttgacataaaaaagcacattgcacctgttatgggacagtcactagaagagctaatggctgctctcagtgcagcagttaagctgaaaatgcaaatacacctagaaacccggaagggaatgaggatcttatgttgaagaccgagaggacttttgtatatggggtgagataagggtccagtttcattcttctgcatgtgaatatctagttttccccaaaccatttatttaagaaactatcctttttccattgtgtgttcttggcacctttgtcaaagatcagttaacaggaagtgtgtgtgtgggttaatttatgggctctctagctctctattctgttccattgatctatgtgtctgtcttttttttttcatgctgttttgattactggagctttgtagtacatttgaaatcaagtggtgtattacgtccagctttgttcttttgtccttaagattgctttggctattcagggtattttgtagttccacatgaattttaggatttaaaaaaaattctattttatttttcaagatggtatattggaggctttagcatgactcttccacttggaaatagcaaaataatgcataaagatcaaaattatggctttaattcaagaacgaaaatgggaattcactggaaagcaaaagacatcacagttcctaaggaggcgaaaatgggcaaacaacccttgttatagagtccagctgaaaagtgagtgaagccccaatatgtgagaggggcacacattatgacttagctttctaatggggatccatgcaacccaggccaaaggagagcatcatatttctcccatgccctggagctagcttgagaagaggttgggagacactgagagggaaagacactgggaaaagctgcggagattttcccgaacccagtactgaaagcaggatgccatttttaatccaggcacatacaaagtcagccattctctgatgacttggcagtatggctgtgcaggcattttagtcttgggccagagagtggagcacttaccctggagtagggtaggggtctctacagccataatctaatggcaagtgtggaaagtgccccacaagtaggtgctggaactgtgttctcccctatcaccgcagtaggagaactactgcagctgctgtttcttctgggtggtaagacttgcagccagggccacctggtgtggagacccggaattagtctgtatgtgtcattcatgggtgctccagcctgctcccctgagactgtgctgcagcagggcaatttctgctccatgctcccacagatcttcagacattcaggactccacttgtctggatcagcagcctgagctgccccattcttccagtgcagattgtggtaaagcagggccctctatgctttatgcctaggcagatattcaggcatctggagcacccactctcctggattaggagttcaagctgccccccaacacttccatgcagagaacttggggccaaggaggtttcccagctccaggcctaggcaccccactgggagcctttctcccttggtgctggtgcttgtgcctgccattggaggatctgttaggtgggctgcccagtgtggctctacccatctttgtatgcccccaaggactgagcagggagctcaaaccactgagcaccccacagatcagcccattgcctgaggcaattcagagcttctgtccgtaaacaagtatcaaatatatacctatttgcattgaccactgctggcttttactcataagcaccatctactggcctgtaggtcaaactgatcagcccaaaataaaacctgccaatagaagtgcctagggcatagggctacagaagtagtcaaaagaccctagccaacattttctacagtcacaccttctagggaggaagggggaaggaaaaaaaaaaaaagaacaaatcaataaaattatagggaaataaataaagaaaaaatcttatccacatgaaaatatttacatagaagtgctaggctagcatcaccagatgagaaagaactagcacaaggactctggtaccatgaaaagtctgaatgttgtgacacctccaaaagatcttcagcaatggtccctaaccaaaatgaaatctcaggaattacatataacaaattcaaaacatgaattgcaacaaagcacaatgagatcgaagacaaggttgaaaatcaacataaagaaacttctaaagcaatgcagaaaataaaggaagagataaaaaatcttaaatcaatcagagattctgaatttaaaaactcacttaaagaaattcaaaatatgattgaaagctttaccactagactagaccaagcagaagaaagaatttcactggtatgaataccaatcttttgaactaatccagtcagacaagaataaagaaaaaagaatttaaaaaacgaacaaagtctttgaggaaggatattctgtaaagcaaccaaacctacaaattactggcatttccaagaaagaaggagaaagagtaaacaacctggaaagtatatttgagggaataactcaaggaaattcccctcatcttgctaaagaggtagacattaagacacaagaaatatagagaatgtgtgcaagatactatacaaaacaaacatcaccaaggcagatagtcaccagactgtccaagattaatgctaaagaaaaaaatcttaaaggcagctagagaaaaaggtcagaccacatacaaagggaagcccatcaggctaactgcagagttctcagcagaaaacatacaaatcagaagacattgggggctcattttcagcatccttaaagaaaagaaattccaaccaagaatttaatcccctatcaaactatgcttcataagcaaagaagaaataaaatcttttccagaccaatgattactaagggaatttgttaccactagactaaccttacaagaaatctttaaaggagttctaaacatggaaacaaaagaacaatacctggtccacaaaaacacagttaagtacatagcttgcagaccccatgaagcagctacacaatagaaactacaaagcagccagctcacaacttcacaatcaaaacttcacatatcaatatgtgggcttgagtataaatggtctgcaggcccaatttaaatggcacagaatggcaggtaggatgaaaaagcaagacttatccatctgatgtcttcaagagacccatctcaaatgtagcgacaattataagctcaaaggggttggaaaaggatctatcatgcaaatggaaaacaaaacaaagtgggagtcaatattcttagataaaatagactttaaatcaacaaaaactaagagaaaaaccaaagaaggcaattacataaaaataatgcattcaattaaacaataagatttgactatcctaaatatatatgcattcaacattggggcactccagttcataaaacaagtacttctaggtatatgaaaagaacttagccacacaatgatagtgaggacttcaacactccattggcagtgttagacacatcatcgaggcagaaaactaacaaattctggacttaaattggacacttgatgaattgggttaacaaacttctacagagtacttcacccattaatcacaaaataaattcttctcacctgcacatggaacatactccaagattaaccacatgctcagccataaggtgagtctcaataaatttaaaaaaattgaaatcatacaatttatacttttggaccacagtggaataaaaacaaaagtcaatactaaggagatgtctcaaaaccaaacaattacatggaaattaaacagcttgtttctggatgaatttgggggaaacaacaaaattaaggcagacataaaaaattctttgaaataaatgaaaacagagataaaacatccaaaaagttaacaacctaacatcactcctagaggaactagggaaatgagaaaaattaacccaaagttagaagaaaagaaataactaaaatcagagcaaaactgaatgaaattaagatccaaaaccacacaacttcccaagactaaatcaggaagaaactgaaaacttgaccagaccaacatggagctccaaaatggaattagtaattaagaaaccgtaccaaccaaaaaaagccctagaccagatggattcatagctgaattctaccagaggtacaaagaatagctggtacccattctactaaaactattccaaaaaattgaggaggaaggactcctccctaactcattctatgagtccagcatcattctgatactaaaaatctgggaaagatagaatgaaaaagaaaaatataggtcaatatctcagatgaacagacacaaaaatcctcaacaaaatactagcaagctgaatccagcagcacaccagaaagttaattaaccacaatcgagtaggccttattcctggcatgtaggtttggttcaacatatgcaaatcaatataagtgattcacctcataaacagaattaaaaacaaaaaccttatgattgtctcaatagtgcagaaaaatcttttgataaaatctaacatcctgtcataaaaaccctccacaaactaggcattgaaggaacatacctcaaaataataagagccatttatgacgaactcacaatcaacatcatacagaatgtgtagaatctggaagcattccccttaagaacatgaagacaaataggctccttctcaccactcctattaaatctagtagtggaaattctagtcagagcaatcaggcaaaagaaagaaataaaagacatccaaataggaaaagagtaagtcaaattatctcttttctctgattctgtacctagaaaaccctaaagactctgccctaagtttcctagaactgataagcaacttcagtaaagtttcaggatacaaaatcaacacacaaaaataagtagcacttctactcaccaattacgttcaaactaagagccaaataaagaatgcaatccatttacaatagacccccaaaaatacctaggcatacatctaaccaagatggtgaaagatctctataaggaagactaaaaatcactactgaaagaaatcgtagatgacacaaacaaatcggaaaacattccatgctcttggattggaagaatcaatgtcgttataatgaccatatcgcctgaaacaatctacagattcaacactattcctatcaaactaccaatataatttttcatggaattttgataaaaactactctatattcaatatggaaccaaaaatgagccaaaatagccaaggcaattctaagcaaaaagaacaaatttggaagcatcatattacccaacttaaaccatactgtaaggccactaaccaaaacagcatggtactggtacaaaaacagacatatagaccaaaagaacagacagattacctagaaataaagcaatacctctatagccagctgatttttgacaaagtcaacaaaaataagcaatagggaaaggattccctattcaataaattatgctgggataactggctatccatatgtggaagaatgaatctggacccctaccattcatcatatacaaaaattaactcaaggtgaattaaaaatgtaaatgtaagacctcaaactataaaaattctggaagaaagccaaagaaatacaattctgaacatcagccttggcaaagaatttatgattaagtccccaaaggcaattgcaacaacaagaaaagtcaagtgggacctaattaaactaaagagcttctgcacagcaaatgaaaccatcgcagagtaaacagacaacctacagaataggagaaaatattcataaactatgcatacaacacagttctaatatccagaatctttaaggaatttaaacaattcgacaggcaaaaaaaccccacaaataaccccattaaaaagtgggcaaaggacatgaacagacacttctcaaaagaaggcatataagcggccaataaacatactcaatatcactaatcatcagagaaatgcaaatcaaaaccacatgagatactgtctcacaccagttagaatggctattattaaaaagtcaaaaaataacagatattggcaaggttgtgcagaaaaggaaatgcttgtacactgctggtgggaatgtaaattagttcagccactgtggaaagcggtttggagatttctcagagaacttaaaacagaaatgctattcgacctggcaatctcattactgggtatatatccaaaggaaaataaactgttctaccaataataatagtaataataataacctatacactcttaaattcatcacagcacaattcacaatagcaaagacatggaatcagcctagatgcccatcaacagtggattggaaaattataacgtggtacatatacaccatggaatattacacagccatagaaaagaatgaaatcacgtcttttgcagcagtgtagatccaactggatgccattatcctaagaaaattaatgcaggaacagaaaaccaaatacttcatgttctcacttataagtgggagctaaatactggatacacataaacataatgatggcaacaatagacactagacaactagaaggggagagaggaaaggatgcaaggagtggaaaactactattgggtatatgctcactacctgagtgatgggatcatttgtacccaaaccttaacattgtgtaacatactaatataaacaatctgctcgtgtacacctgaatctaaaataaaagttgaaactgtaaaaacaacatcaaaaaattctgtcagaatgtcattggaattttgatagacattgcagtaaatctgtagattgctttggggaatatggacaatttattcatttatttattttaatgtatattatttttaattgacaaactagaattgtattacatttattgagtacaatgtaatgttttgacattttgtgtagtgatatatttgaaatttgctctctctattttgaactaagccatacataattattgactgtattcactctcctgtgcgatagatcttaaaacatatccctgctgtctagctaaaaattttaagtttttgattaacaaatccccaagtcctttgctgccctctccctctagcctctgttaactaccattatactgtctgcttctatgaattcagctatttttagattctataaataagtgagatcatgcattgtctttccatatctggcttatttcacttagtgtaatgtcctttaggttcatccatgttgtcacaaatgacgggatttccttattttataaggctgagtagtagtctattgtgtacgtatactacattttctttctccattgatagacacaggtttattccatatcttagatactgtaattaatgctgtaataaatatgggaatgtagatatccctttgatacaacgatttcaatgccttggatatattttcagaagtaagattgctgaatcatattttagttctatttttagttttttcaggaacatccatatcattttgtataatgtttattataatttacattcccaccaacagtgtacaagtgttcccttttctctgcattctcaccaacacttttcttttctttttttctttttttagatatataagccattctaacaggtgtgagttgttatcttactgtggttttaatttgcattttcctgataattagtgatgctgagttttttttttttcctaaacccgttggtcatccctaggtctttgtttgagaagtgtctgttaaagttctttccccatgttcaaattttttttcttgctactgagttgagttcattacatattttggatattaaccctttatcagatatatggtttgcaaattttttttccactctgtgggttgtctgttcactttgttaattggttctttggctgtgcagaaggtttttagtttaactaacaaaagcaatccaatttttctatttttgctttcgttgcctgagctttcagggtcatattcaaaaaattattgccccgagcaatgtcatggagctttccccctatgttttcttctaatagttttaaagtttcaggtattatgtttatgtctttaatccattttgagtttatttttgtgtatgctgcaaaataaaggtctaatttcacttttatgcatgataaccagttttcccagcactacttattgaagagactgtcctttacccattgtgtgttcttggtacctttgtcaaaagtcaatcgactgtgaacgcttaggtttattccctggctttctactaaattgttccatttgtctatgtgtctgtttttatgcaagcactgtgctgtttttactactgtagctttgtagtagatttcaaaaataggtcaggtgatatccccagctttgttatttttgttcaagattgccttgaactgtttgtggtcttttgtgctttcacgtgaatttaaagattatttttggcctggcgtggtggctcacacctgtaatcccagcactttgggaggccgagacgggcggatcacgaggtcaggcgatcgagaccatcgtggctaacacggtgaaaccccgtctctactaaacatacgaaaaaattagctgggcgtagtggcgggcgcctgtagtcccagctactcgggatgctgaggcaggagaatggcgtgaaacctggaggcggagcttgcagtgagccgagatcgcgccactgcactccagcctgggcgacagagcgagactccgtctcaaaaaaaaaaaaaaaaaaaaaagtttttttttctatttctgtgaaaatggcaatggaattttgatgtaagttgtattgcatctacagatcacttcgagtaatatgaacattttaacaatgttaactttttcaaaccatgaacatatttttatatgtgttttcttaaatttatttgattagtgttttaatagtctttagtatacacgtttttcacctccttagttaaatttacacctaagtattttattttctttttttgctgatgtaagtgggattgtttccttagttttctgcttggataactcattattagtgtatagaacactacttattttcatatgttgattttgtgtcctgcaactttactgaatttatcagttctaacaagtttttggtggactctttagaattttctttatatgagattatattgtcagcaaatagaaacactttcattaattccttttgtcttaggattccttttatttctttctcttgcctagttgctctggttaggacttccagaactatgttgtaaagaattgtgagagtgggcctccttcttttattcctaatcttagagaaaaagctttcaacttttcatgattaagtacgatgtttgctataggtttgtcagatatggcttttattgttttgaggtacatttcctttatacctattctattgagagtttttatcatgaaaggatattgagttttgtcatatgctttttctgcatctaatgagttgattacatggtttttattcttcattttattagtggaatgagtcacatatattcatttgtattttttgaaccatcctcgcagccctgggtaaatcccatttgatcagggcagatgattcgtttaacatgcggttgcatttggtttgctagcagtttggtaaggatttttgcgtttaggtttatcaaaggcattggcctgcaattttcttttctcggagtgtccttgtctggatttggtatcagagtaatgttggtcttgtaaaatgagtttgaaagtattccttcttcttcaatattttggaagagtttcagaaggattggtatacaatcttctttaagagattggtagaatttatttctaaagccacccagtcctgggcgtttctttgataggagactgttactgatttaatcccttatttattgctgatttaatccctttactcactattggtctgttaaggttttctattcatgagtcagttttgttaggttctatgtgtttaggaatttataaatttcttctagatatccaattatctggcctacagttgttataatcatttgtatttctgtggcatcagttataatgtgtccactttcatttctgatttttatttctttgagccttctttctttttttcttagttagtctagctaaggtttgttgattttgtttatctttaaaaaaataattatttgtttcattaattttttctactgttttcctaggctctattttatttatttctgcttggatctttgtcattcctttccttctcttaactttgggcttagtttgttcttctttttctagttccttgagatgtaacattacattgtttatttgagatcttttgtctttttgatatagacatttattgttattattttccctcttagcactgcttttgctgcatcccacaaaatttgttttgttgtgttttcatttttgtttatctcaaggcattttttgattttctttttttatttcttctgtgacccattggtttttaagagcatcttgcttgattttcacatattttaaaattttataaggtttctcctgttacagatttctagtttgatgtcattggttggttggtatagttttaatcttccgagatttgttaagaattgttttgtggcctaacatacagtctattttagagaatattctatgtgctcctgagaagaaagtatattctgttgctgtttggtggaatgttttgtatgtgtctgttagttctctttggtctgaggtgtaattcaagcctagtgttcccttattaactttctgcttagatgagctgtctattgttgaaagtagagtattgagatttcctgttgttatggtattgcagtctatcattcccttcagaaaatttaataattgcattggtatatatgtgctcttatgttgggtgcatatatatttacaattatattcttttgatggcttagcactttctattgccgtaaaatgacctactctgtcttttttatagtttttgacttaaagtatattttatatgctataagtatagctaccatgctctctttgtttccatttttatgaagtatcttttcccatcccttcatgttcagtctatgtatgtccttagaaggaaagtgagtctcttgtaggcagcatatggtttgatctttaaaaaaatctattgagctcctctgtcttttgattagataacttaatcctgttacagtcaagacaatttttgatagtttaaacttactaccattattttcttaattgttttctggttgttttcttgatcttttgtttctttcttaatttcttgttctcttcctttgtggcttatagttttctgtggtggtcttctttgatttttttttatattttgttctacaggattttgctttatggctaccatggggcttatataaaacatcctaaatttgaaacaggctattttaagctaataactttaattacaaacagaactgcacattaattccctccttccccttgtatacttttgatatttacctagttttataatttatatctcttaattatttattgtagctacagttatttttaatagttctttttttaatcctcataggacagataaaattgttttatgcttcacccttacagttttagaatattctgaatatgattacatagtcatattacttataccattgagatatttacttttgtgtttttgttattaattagcagattttcattttagcttgaagaactccctttagcaattcctatggagcaggcctagtgatgatgaattcccttagcttttgtttgtctgagaaagtttttatttctgcctaatttctgaagagcagactttccaggtaatgtatccttggttagcacttttttcttcagaattttgaatatctcattctactttctcatggcctgcagaatttctgccaggaaagctgttaacagctgtattgggactgctttgaatgtgatgtttcttatctcttggtgttttttttttgtcttgcatttttgataattttattctagaattttttgataattttattctagaattaatgtttgggttgaatttacttggagacttatgagcttcctatacctgaatgctgtcatctttcttcagattttgaaaatttttagtcattattaccttaaatgtgctttctgggcctttgtctctctcttcttcttcttcagaaactcctattatgtggaggttaattctcttaatagtgtcccataatttctgtaggtcttttccattcttttttctttttactcctctaactggataatttcaaatatcctatcttcaagttattctttcttccacttgatcaagtctgctgttgaagctttctattgaattttatagttctgttattacatactttatctctaggatttctatttttattgtttctatttatttggcaatctcctcattttgttttataaattgttttccacatttaatttagttttttatctgtatttacttgtagtcccctataagtaatacgactatgtatcatattcagaatattctaaagctgtaacagtgaagtataaaaaagctttatctttcctgtgaagattaaaaagacacaactattaaaaataactgtaggtacaataaattattaacggatacattttacaaaactaggtgaattttttttttttttttttgagatagagtcttgctccgtcacccaggctggagtgcagtggaatgatctcggctcactgcaacctctgtctcccaggctcaagcaattctcctgcctcaacctcccaaatagctgggactacaggtgcatgctgccacacacgactaattttttgttttttagtagagacggggtttcaccgcgtttaagataattgttctgaattcttcatcagtcattttataaatcttcacttcttcaggatcccttattggagatttattaatttccttatgatgatgatgtattttttcagatttttcataatccttgtgtccttgcattggtgcccaaccatttgaggaaatggccaactattccgcctttgtttgtgttatttggccatggtataccttcactatttgatcaaacctggaattctgattaagcaagttggtggtgaccttgaacgggaagaccttgctgtcatgctctctagctgggctgaactgttaactgtactggttgagtagaatttctggctctgttccatggtctggtgagagaactggctggactctgtaataagacagagctgctggctgaaattgcctctgattgagcagtattgttggttgtcttccttagatggccagtactacagttttgaatatgtagttgggcaaggccatgttttaggtgtcaaggctgaacaaagactctgagattgctacctaaccatgcagggtgacaggaccagaggctgtgctccacagatacacatgggcatgggttcagctctaatcctgggatgacctaaggcagagcaccatggcttgatatattagccacttggatgctgggcctgggtggaacagatgctccttctacagttaattgccaccatgcccctgttttctggccttaggaagcgttaaggagcacaaagggcagggcttgactgggtgaaagcttggcagctgggaatggttggggccagatgttctctttgcaggtaattgccattctacccttatctcctggcctggggaagtttcaaggggagcactggggctgagtgtggaagctgagcagagattcaaacctggcagactaatcaactgtgcttcttgttgagcattgcaagcctctctggtggtgtgcctctgctggccagaatgcagagcaactatcaagacccctgaactggtcactgtgagtctcaccctgttctgagtttctaaataaacattgctaatgtttcctgtgggataagacaagagagtttcttctgcgaaggattccaaaatggtgggaaagctgaatgttcattctcaactctctcttccctctgtaaaagccatgggttctgggaatcctcttatgtgtgatgtgctggcttgagggagggacagtgtggtcaaagtaaaacctcctcttgctctacgtgtgtggtttttctcagtactgtggtccaaggggatgtctgtgcctcacttcaagttctgagatattcacaagggtatccttgtctgctgttggttgctagttggatttctgtggtgggactactggagtcagagaattcctattctattatatttctaacatctcccctagtatgaacattttagcaacattcacttttccagtctgtgaacatgtaatatctttctatttgtgtcttcattttctttcctcaatgttttatagtttttagtatacagatctttcacttctttggtaaaatttattcctaagtattttttggatgatattataaatgggatttttaacttctttttttggatagttgttatggtatgtgtaagtgctactgatttctgtacgttgattttgtattaaagtcttaaacataagacctgaaattttaaaactactggagtaaaacacagggggaaaacttcttgacattagacctgggcaaatattatttttgaattttgaccctaaaagtacaggcaacaaaataaaaaatagacaaatgtggttgcatcaaagtaaaaagcttctgcaaaataaagcaaacagttaatggagtgaagagacaacatacagtatgtgataaaatatctgtgaactacacatctgataaggagttaatattcaaaatattttagaaactcaaacaactcagtagcaagaaaacacataaaccaatcaaaaaagtgggcacagggagtttcccaaaagaagccatacaaatggcctacagtatatataaaaatgtgctcaacatcgctaataatcagggaaatgcaagttaaaaacacaatatcacctcacatctgctagaatggctattatcaaaagacaagaaataacaagtattggcaaagatttggagaaaagggaacctttttacagtattagtgggaaagtaaagtagtatggccattgtggaaaacagtgtgaagtttccttaaaaaattaaaaatgaaactactatgtgattcaacaatcccactactgggtatatagctaaaggaaatgaaatcagtattttgaagagatatctgcactcccaaatttattgcagcattgtttactacagtcaagatatagaatcaacctaagtgtcctttagtgggtaaatggattaaaaaacatgttatataagtgtaatggaatacaactcagccttatataaaaagggaagtttctaatttgtgacaacatgtataaacctgaaagatattatgctaagtaaaataagccagatatagaaagacaaatattcgtgatctcacttttatgtggaatcctaaaaagtcgagtgcgtggaagtagaaatgatcattatcaggggttgggttggggagtggggaagaactggggagatgttggtcaaaggatacaaaatttcaataagaccggagtaataaattcaggagatttattgtacagcatgatgactataacaatgtattgtatttttgaaaatttctaaaagagtagactttgagtggtcttattacaaaaaatggtaagtgtgtccagctgtcattcctggagaacacctgaaaaccatcaccctttgggaccatcagtgcaatagaggactgacttacaaaggctgtggtcttaggcttgaagtctttttaaacacttctgtgatagtgcttattctgtcagatcaaatatatttacttttctgagtgatagtccatttaggctgtaaggtgctcaatggaagaaatatgtccgatacatctccatactactactgttgaaagaagtaaaacgaacagagcttggaatgaacaagcagaggtgggcaggaggtacagggtggaccagagtgggaagtacttctgcagtcacgaggacatcctgcttccatcttattaaatctttaggcatgtgcccaggaagacacaggggtcatcttattacacctttaggcacatgctgaggcagcaggcaactgggaagtgtctggtgctgtcacctccctggttgtgaaaacagcagcatactcaggttgtgcatcatcgtgtacactgcacgggataaaagggctcctaccctgggcttctcatccacagcatccttaggagcagccttcttctcctacctcctctgcatctggtgagtggccagcaggggacagatcctcagctgggagtgtttgggaaagagaggcccagaactgaaatggaaccatcagaaagaagcccacagtgggcagcagtgggggaggtgatggagaataaggagcctctaaagcacatgtcagggacccgtgagctgcaaaacccgcaggaccttaggattccttcacattcttgtttggagcatgttgtcaggaatgcacatagatccattttatatttttaaggttgctttatccaaatgcatgtgtagggttccctctactacattcccatttctctcctacagatcttggcttagaaagtggcttcatcaagggggtcagtgtgtgacaaacccaaaaataaggagatggtctgagggttctgtgctcaaatgtttctattattctgttcaaggtaaaattcctgcattcctgcaaagatgtcctgccagcaaaaccagcagcagtgccagccccctcccagttgtccctcacccaagtgtcccccaaagagcccagcacagtgtctgcctccaccctcttctgactgtgctctaagctccgggggctgtggccccagttctgaaagtggctgctgcctgagccaccacaggcacttcaggtcccatcaatgccggcgccagagatccaactcctgtgacaggggcagtggtcagcaaggcgggggctcctgccgtggccatggctctgggggctgctgctgacctggatcctgatgatgagacaagtgatctttggaggaaacaaggatcccaaaggcccaggaaaagctccatcctgatgcatgcttttccagataccttgttctggctttcacaagctgagctgggggtgttcctgttgagtatccaagctgtccccagaaggtgcttcctgtctggtgtataggatctcacagttccctcatccctgcccctgccaaggattggcagttccctgtgcctaaccctgccaaaaaataaagcttcttgttctcattaccacggtgtctcacttgttaggaaactatccaggatttatccatccaggccaggttctcctgtcacccgaactcgcaggaccttagaaagccagagatttaagtgtgttacccctggtagaggtgaccccagagagctgacctcatgctcgggcaagtaactgggctgtgttctcccagccaaccctctgtcatcacaggacacctgctcagcctcagacctgtgtagtttttgctctgatgacaaacagaggagcgaggaattgggagcccctcatggaggggaggaaaggttgatgggcaccatcaccaggatgggtatggagcctcccaagccaggcatcagggttggggctgtggagaaactcatttgtggacatctgctgcattccataggaacagaaagggccccccattacagttctggggtgttctgaaacttcagaacttactcctctgttgttgtatcccaatgactacagattttactcctaagaagcaaaagtggtcactcagctatattcagccccacaatctggctaccatgagaaagtgcttggtctatctcttttaaatgtctctttgcaggacagaggccactgaagggacccttaacattaagagtaaagtggccacccaagagtagttcaagggataattcctgaaaatacttccaagacagagacaggggtcatgtgctggaggcaggaaaatgctgctgagaatatcaatacctaaacctaccctctccccagtccacattcagagccaccctctttcctacggcccagtgcctttatgctcccacaggcatcactatttcagtttgctagggtgggctgtcaggcagaataagaagacaaaaattataaccccaatagtgaacataatttaatttttgttgacaattataatttaatttaaatatgtataaagtttgattacagcctgactgatttatcttgaaaaatatctagaaaaaggtacttattttaatattagagattaattgaatgagaaatttatctacaattaaaatgaaattcgcagagaaaatagcattcagtttgcatcaattctccgtacccaaaatatagacatgatcaggtcagctccattacatgagatgcacccagcactaccatcaacctcaaaagcagcaacacataccaaagtcatcttcatcaagcccatccattatcatgcatgcttgcagaacttcatttcgagtccaagcagatgaacgactcctccctctgtgttttcatggtcttcaaataaagagcacacattccctggattttgatggaaggtcatgccttttgtaatgtgcttactgtgactcttggcactccaattgttgtactttccttctccatatttgcccctcaatcaggtattcatttggctcccctcctctcctgcccaggggcctatgttacctcctgggtaccagtgaggctctttcaagagtcctcatctccgctgactttacccttccatctgttttacacacagcccattctgaatgtccagcatccttacctcagtcaccaccccaacagcaagtgctgatcacatctgatgcttgattttcctaagggaacattacagaaaaaagtagatgggcaaagaaccatggacttcgtgggtagtcatttacattgcagtacttatctcatggaagcagtctccctatttacttgactgcctgtgcagttagacagttaatttctataggtcaggtgatgtgtcatattgaactctaccttccaccacaatgcatggagcatgacatattttaagcacacatgtaggcctgggtggaaggtgtacaagtgaggaccagggcttcctgtgtcaaacatgccaccctgttcctgggaagacggtgaaggcctggacctgggctgggttgtttggtgctgtcacctccccgagcaacccattcatgctgcccctcacaatctagcagctctgtcttgggcttcccagaccatggacttctttcgaataagctttctcttgctgccatgaaaccagatggatgtctagctggagacaggacctgagctggaagacctaggaagacaagcccgggtttcttccatcaggggagaaggaagcagagggtatgggatggaggaagcaggaagagtgtggggttaatgggcaccctcccgggatgtatcaggtgtcctgtgactgcgaaggtcatgggtcttcagcacaccctcatcttcttcctatatatgttctgagagatgcactgatctcaccagacatcatcaaggaagctttacccaaacaggtttattctcctctgtgattacatgaagataggacacctcagctgctcaattagaaaagacccagtatcattttgtagcaggtgaccaaagagaaaagaacatctttccaggataaactaactccaaatttattttcatttcctccctatatttcttttcttttcttttctttttttttgagacggagtctcgctctgtcacccaggctggagtgcagtggcgtgatctcggctcactgccagctctgcctcccaggttcacgccattctcctgcctcagcctcccgagtagctgggactacaggtgcccgccaccacgctgtactaattttttgtatttttagtagagacggggtttcaccatattagccaggatggactcgatctcctgacctggtgatccgcctgcctcggcctcccaaagtgctgggattacaggcgtgagccatggcccctggtcctcctccctatatttcttagtgcagaagtacacccatcagagaagagatattacaaagattcatttgcattattgcattctctctagagtcattgatgctttctgagattttgtgtcagcaaaacgcgcagcagggatagcctccaaaggctcccagagttccccacccagtctgagccccatgtctagtctaccttcagtcttctcctgctatggctccagctccaggggttgctttaactcttagggggcagctgcagcctgggctaccacaggtgctatctcttccactggcacaggcactagagacatgactgctgtgagtttacccactggcagctgcagctgttgccagagctttgggcactgctgctgacctgggcagtgcattgagataagcagttttagaggaatcagagacccaaagtgcccaggattaacctcagtctgatgtacctgctcctaacctcctgcccatggtcggagctcctgagttcatcctgacaagggttgtcagtgatctccagtggtctccctggtgtccctcatggttgtctccacatccatgttctggtcagtgcttagcagcacttatgtctcactctgtaaaaaataaagctttcctttctcacctacgtttctatattgcccctccgaaggctgctccattgctctcccatgccttatctcccagactgaatgcttcacaggatgagaggaatgagagacaacacttctctctactcatagggagaccatgagttgctgctaggaagaggctacagaaggccacatggctgcagggaggaaagttcaccttatttctatatggaagatctgggtgttgaggaggtaggaagggatccttgaaagctgaatagttgatgggtgcaaggagagaaatgtagatggttgcagaggtatacactgagaggaacttagaagaagtaagaaaataaaaacctgatcattgcaggagttgtaaactggatatattcatagggtcaatgatttgtatactactcatgatgtgccagtggcttgacatacagtaaataatttaatcctcactgcagtccttcaagttacgtacaacccttgtcccattttacagatgggaatcatcatggaatgagtgtccagggtctcccaacagctgccatgcaaaccttggcagttttgctgagaagcctatgctcctgatgactgtggtgttctaagttcttctaaaatgttttaagagatgtgagtaaacaatggatttgttttgtaattattttagtccacagtattttgttgtttgaattatacatcactaaaccaccaaaccatatgaatcacacttttaaggagttcgcctcccagagtttggacccagagtgtagtattcagctgcaccacaggattaaaatcattatttttgatgtgcattaaaacaacaattcactttcactaccaattttgagaatgttaatgaactggagaaagactcagtaaaaattcaagccttggtgctcatcagtaaaatactagcaatccaaggaggtctcataaactctgagccaaagtgaaagagcagatcttaagagtagtttagggctagatacaacagagaaattaatgtatccagtaataggtgaatatattaaattttagaagctttttttccaagctcttgggaaatagggaaaagaaaattactcccctcttctgtgttcatagacattcattttcttaactcattgggatgaaaaaggtacccaaagggatcctatgaggaagttgatgtcagaactgctctgatgagtttagatcgactgcccagctcaattcctcttagttgccatgcctgggtttattgcccttggatggatacaggctccacatcttactcatcccatcaaccatcccaggtgacagcaggtgacaccatctggattcatcatttactctggctggattcatcatttactgattcaactagctaagaaagatttgtttaagaagttaccacagctgtaggacttataaaagcctatgatacagacttttgattcactacgacaaccacttgctactcaaaaattgagaaactcttgaataaaatcagcccaggcgacataaagaatgttgtgttatgacttctagaccaagtccaacacccaatcattcataatttatctgctcaacacgtagttttgtggcactggtctaggtgtttagatcagtgtgaaacaagatgaagtcccctttcaggcagcttatgttccagtgggcccattggagacatcttctggtttcctggcttgtcagcagatttagacaaagatggttctatattcagttggattcccactctggggcacttgacagatgccggtaaagggtggctaaacccagtgaaggcacccatcatgggcaaacttttgaaaactggatatcattttttgggtgaatacaaaaaggacatccaatgtctggttgtttccacatcaaaggtaggagcttagtgagtcaaggggtaggtgggtgattccaatggtgaaatgtttgtttaaaagttgaaaagtccttgtcccttcccagtgcctttctcacttcccagttctcagtgaacaaccccattcacccaagtatcttgaaagtgcttctgtttggtacttagctataatgtatggagcaaataaaaaaaatggccacacctatacccttccctgtatcaggatactcagacacatttaatgcaataataatgttttattaaaaccttgtcgttttaggatatgtttgaaacttacatgtgtattccatttttacatacttttaatatatcatgattcaggataaaatatatatctattattataataaatgcattggaaaaatactatagagtttagtgctctctctacaaccttggtccatgttgtgtcaggtgctcacggtgatcatattaacctcattataatcatacccatcaattatcatttctatttggacaaatctcttttagtcatcccatccaatttgaatcactctcttccctgggtctcttagaatcaatagtacagtcgctaagatcctgacacaaggttccttaaatgtatgttaatccatgatgcatattaccaaagccattgtggatttcttatacttgtctctgaatttacctgtgatatccctgggtcattttgcctccatgtaaacagatttgttttgcctcagacatctttaccttaatacagctattaggagaagcagggaaagattaaaacctagaagttcctgtctccaaaatggatgctcttaatgagcaaattattctgcattcaagactgtacatgtccccagtattcccctcagccctgttctacctcgacctcagcattgtctctttctcctgggcacctccttgatgtttcttgggtccacaaatttctcttagttgccatgcctcggtttactgcccttggatggatacaggctccacttctcattcatcccatcaacaatcccaagtgacagcaggtgacaccttttggattcatcatttattcagagtcgctacagaaccaaaagggactaatgccccaaaaccctgacttcaggcctggggactcccacacactgtatcccagcaccctctcctggctcaggcttagtttcctacttatctgtcagtctcactacaccatcagcctaagggtagggatggtatcttcttcagtcttgaatctgctttgcccagcacagtgagtgtcaccatctcaatataacttgtttaaagaaggaatgatgttaatgaatgaaaaatgaagaattgcagacctacagaaagactgaggcacaggtatgtgaatagtcacggggtttcttgaatccccactctcctcaaaactcttgacacctgccatggagatacagaggtcttggggctacagaggcaaagaagctgactcctaaacgagactcacattctcacccctcccaatcccaacacccatttcttgcctgcaaaagaaaatagaaaaagagctctaaggtttgctcagtcctcactggaatcaggatgcctcaacccaagttactttctatttcctgcactcctctgctcgggaatttttcctaagttgtggattcaaagccacatatgctttgaaataaacataaaaagatccaatttttgatcctgtttgagccatcacaggctttacacatcccacaaggcacagcatcagccctctggatgctgtcactcatgcagtgaccagggcactgaaaaccacagtggagcagggctggatgatccagtgaagcaaagagagaagcctcttcccagtgtggtgattttcctcctccctcacctctgctcctccttggtggagaagtcccgtggaacattagtgaagataataagggtgggaatgcccttgtagaaattactgttaatagtctgagaattgggcaggtactataaatcctaatcttttgtgtttcaaagccatttgcatcaacaagtgtttggtttcgaactcagcgtatccttgtcttagtaatcccttcttaggtcttattaccagaaagatcctcactcaacagaatgcccaggtgcagttccagtcagaacactcttgtggtgcccactcccaattttctctgtcaaacgtcattgagctctttcaatgcttcctttcacttttcccccaaccactctgctgcagttttgcatcccacagtgaacaagcttgtgtccattccaagccccctggagatgagacctccctcagagccaaagtatattcattgagcagagtatctgtcactaaagtgatgcagctgcctgggacctagcacagacccttcatgcccctaatatgtccattcctctccctacattcaggataggcagaatgttgaaagaaaacatggtaaaagataactgtagcaaagaattggcaaaagagatggcaggtgttgaagaaacggaatttgtcaagggtcatattggtcagggtcttctattgcctcccagagagttttcctttttccccatggactacaggtaagtagcacatgaatattctcaccatccaacacccaactccctgtcctccctcttgatcttctaagatactcctgttcatgaaagacttcctccctgaccttccaaactccatcatgtctccagtaactacccagtttctacttccagttgcctttacagtacctgtgtgtggtcattatgaagcttccaccaacattcctgaacttgcttctcgtttgtccttggggacctgaaatctgggcatttattgatttgattgatgctagaaagggtgggagaatccaaaactgcccctttcttataaaaacctaagagcctactaagttgtgtattgaacagtctaaagtcagtacaataaaaacatgaagcattgtctttttcggtcattgttttttcctatgctctgttgaatctctcttgaaaatacctcagggaaattccacatttcgtcagtcacttctatggatactaaagtccagaccagctaaatttaattctgaacaaaatttgaaactcaaattctcccttgcacacaagcattgtccaggtatctcccaggagactggagttggaaggggaatatgatgggctctttctctcattcactaccacccctccaccttcttcctcagtagcccttcctcctccattgtattgggagatggaaaaggggagggagaatcattacacatgtgactgtaccactagcctcctctgttggcaggttctgcggcagggctgtctctgcttcttctgtgtggcaggttctgcaggagggctgtcttatagggtgcttttgtgagtcctggagtatcttcaagcattttcctaacagcatgatttccagacatgggatgagcagtcggatttaacccttcacgtactccctaagctcctaccttcgttggcaccagccatggcttctcgataatgaggtctgtctgcccaacagaaaaccatcctaagcacaacactagcaagactgtggaagctggtcttccttcttagatgtcatctgctgttatgtctcaatgtcctgttctatctcttcagttccttttctttattcaacaataggctcagaggttagaacatcaagtctactactacagcagacattctgctgggggataaaaatgctgtctttctttcttgaaggaatctctaacatctacaggctgtcattgtgaatcctgccctttcaattgacctctgttgtaggagaacaaccagtttccctcccatgtacaagattagggggagactacatcattgtcttttaggataataactttcctatctaaaaaattctcaccaaagttcaaccttccaaatatatagctgaaccagagaaatagagttctatttttttttcttagcaagtcttgcagagattttcagcagcttatcctaagtttactttagtatatggggataagaggcatctactattttcatcttttgacttcagccaacatcgtaatacaagaagaaaatttgagtccaacatcttcttacacactgggtcctaccagagctttctcaggagaatagagcggtgtaaatatctcaaaatactatttaatctgagggaaaaattcaaatccatataagaaacttaggcacgttggaggtatatggcactttctggccactgcttcccattttccttaagaataacttagctgcttgccatggaatttgattgtcgcagacatggcaggaacagaatggagaaggaactgtgagttttaagcaaagggagaagaattctgtttgttgactcatccttgattgctgatgtggaatgtccaaaatgcactccaaggggctaaatctgaggtcctgcagtgcctgttcctatagtaccaattggaatgactaagtcatgaaatttttcctggattcatccagccagagcagtctctgtatttccttgatgtctttgggccacaggaagccaaggctcctcaggatgggactctcaggactagtgattctcagggaggtgcccttgtgctgtaggggaagtgacaagatcatgatcttatagctactgtttgtcatcacgggacaaatcctgtgcgtgtgagaactgtggacacctgatttcaggaagaggagagtggtgacaggagcaatcactaaggtagaagggagattaatgagctctccaggtcttgtggggaggctttcaagacaggcagtcaagaatggggctggaggaaagcctaacagtcatctattgtgttttataaaacagcggtaacacgatatattgaatgtcataggcaaggattttttttcctttgaaacttgcccaaaatgtgtgatttatgtttctttctcaattaacgcttccatctcctacctccctcagctgccaatgactcagggttgcaacccatgcaggaaaatggctatcatgcttgctctgttgggaggacaagacttgcttatgataaatacaagatacagagaaataaacgttcagatttgcagcaaagtctaaaccccagtaattttttaactgaatttttcaacagattgtgtccctcttcaacttcaccagtatggaatgagaaagtacccatttcaaccatcatgagtaattccttccaatgcactagcaatttgtgtgttctaaagaatgcaaaagaaatggacacctagtgtagtcccggggctaagcccaaaaatatcccttcagcaagaggcttctgcaggcagaagaatatcagagaggggagtcaatgacaggtctgatccttttcctcttcctccattcccaagccacattcctagagacaattcactttctcttaaatatctcaaaataaatcatggaattctgccccccacctcccaccatgttttaaagagggtaagttgtaaagtgcatactctgataaggagtttgttgtctaaaagccataaactatcaagtacagggagcaataacaggcatttaccataaacatgtgttatttaaaattaccatttaacttaaatttaatgttctgttatagttctgactttaactttttagaaacaaatagcaaagttcaggtattataataatagagatgaattcagtgaaaaattcatgtctaaaactattatacaatcaaatgggaaaaatacaaatcagactttatatgtcatcctacagaaaccttagaatttataaggtttgttccattaaatttgat

SEQ ID NO: 275 - DNA, 43678 bp, Homo sapiens
tttcaaacaaacatttcatggttggaataaccacctattccttgcctcactaaactcttaccttgggtgtggaagcaagcagatattagatgtcctttttgtatccactaagacaatgatatccaatgtcaaaagtttgcccatgatgggtgccttcactgggtttagctactctttaccagcatctgtcaagtgccccagagtgggaatccaattgaatatagagccacctttgtctaaatctgctgccaagcaaggaagccagaagatgcctccaatgggcccctggaacataagctccctgagaggggactttgtcttgtttcaaactgatccaagtacctagaccagtgccaaataagtatgtagtgaatgaataaatttttgaatgaatgaggcttggcctagaagtcccctgatgaggactgaaaagtctgtcttcacacttactgagacctcacttgtaggaatcagcttccagtggcgggtcaccactgccataacttctggctcccatgaactgtactaatgtctcaacccaaactttcttagttgattctggtgccacctttctacatcttggggtaattcactgacagcaggagttctggtggtactttggagcacagatctgactccacaggcacagctaggtctctgtgcccaggtctagggatccttttttttttttttcatatttcttaaaacattttagaggaattcagggtaccatggtggtcaggagcatgtggtcagtgaaactgtctgggtttgcacggcagcttctgggagaccttgggcacccattctacattgattcccctctgtaaaatgggagaaggctagtatctaactcaaaggactgcagtgaggattaagttatttactgtatgtcaagccactggtacattatgagtcctatataaattatagatcctatgaatacatatccaatttgcaactcctgaaatgatctcattttttcccctttccctaagttcctctcagtatatgcccttgcaaacacctccatttctctctttgcacctgtcacctaattagctttcaaggatcccttcctaccccgtcaacacccagatcttccctatagaaataatatgaatgttttctctgcagccgtgtgtccttctgcaacctctttccagtcctaacacataaactcctcacggtctccctatgaatggagataagtgacatttctcattcttcttgtcctgtgaggcactcagcctgggagataagaaggggaagagcaatggagcagctttgggaggggcaaaatagaaatgtaggtggagaagagaagctttatttttcacagagtgagacataagtgctgctaagcactgaacagaacatgggtgtggagacaaccatgagggacacccagggagaccgctggagatcactgacaaccctcttcaggatgaactcaggagctcagaccatgggcaggaggttaggagtgggtacatcagactgaggttaatcctgggcactttggtctctggttcctttaaaattgctcatctcaatgtactgccaaggtcagcagtaattctctagcaatggctggagcccctggcaggctcactcacagcagtagaggctgtggtgcctgtgccagtagaaaagatggggcctttgataggtcaagcagcagtgccccactaaagttaaagtgacccctgaactggggctgcagggaaaggctggaggtgggtatgaggcttagtactggggtgtgcactttgaaggctttgggggttatcactgctgctggttttgctggagggcatctcagaagacatcaatagaatcagatgtgcttgtaatgcacaaacctctgtcaatatctcttctgtgatgggtgtcatagaccccatgctctcctactgaactaagaaatacacggaagaaatgaaaagttacttggagttagtttaccttggaaaaatgcgtttttctctggtctcctactagaaaaggatgctgagtcttttctaactgggcccctcaggtatcttatctccatgtaatcacagaggagaataagcctgtttgggtaaaccttccttgatgatgtctggtgagatcagtgcatctcgcagaacaaatgtaggaagaagatgagggtgtgctgaaaacccattaccttcacagtcacaggacacctgaaacatcctgagagggtgcccattaaccccacactcttcctggtgcctccatcccagaccctctgcttccttctcccctgatggaagcctgggcttgtcttcctaggtcttccagctcaggtcctgtctccagctagacatccatctgatttcatagaagccagagaatgctgattttgagaagtcagtggactggggagcccaggacaggagctcctagcatgtgaggggcagcatgagtgggctgctgggggagttgacagcactaagtaccccagcccagcttcaggacttatccaccttccctggaacaggatggcatgtttgaccacaaagagcctggtcctcacttgtgcatcttccacccaggcctacatgtgtccttaaaagaggctgtgccctgtgctttgtggtgaaaggtagagttcaatatgacatgtcacctgacctatagaaattaattgtctaattgcacagacaaacaagtaaatagggagcctgcttccatgagaaaattgctataatgtaagtcactatgcacaaagtttgcaggtctttgtccatatacttctttctagcatgttcccttaggaaaaccaaacacccagatgtggtgttggggtggtgacttgctgttggggcggtgactgagctaaggacgctggacattcagtatgggctgtgtgtaaaacagatggaagcctaaagtcaggggaggtgagggtccctgaaagagcccccgggcaggagaggaggggagtcaaatgagtacccgattgaagggcaaatgtagagaaggaaagtacaatagttgcagtaataagagtcacaactgacgcattataaaaaagcatgaccttccatcaaaatccaaggaatgcgtgctctttatttgaagacgatgaaaacactgagggaggagtcgttcatctgcttggactcggtaaggaagttgtgcaaatgtgcatgataatggatggccttgatgaagatggctttgctgtacgtgttgctgcttatgaggttgatggtagtgctgggtgcatctcttgtaatgaagctgacctgatggtgtctatgtttgggtatgccgaattggtgcaaactgaatgctatttccttgttaatttcattttaattttaaatgaatttatcattcaattaatctctaatattaaaagaccttttgctagatatttttcaagataaatcacagtcaggtctataaccaaactttagccatattaaaattataattttcaaagaaaattaaattatgttcattatcagtgggtgtaatttttctcttactctgcctaagagtttgcccctttaagtacatagtgatgcctgtaggagcataaatgcaccgggctgtaaggaggacagtggctctgtgtggatgggtagagggtgggtgcagattttgatatcctcagcagccttttcctgcctccagcccatggtacctgcctctggttgaaaggtattttcagaatcatttccagaactactcctgagtggccgtttttctcatattgtttagggtttcttcagtagaccctggcctgcaaaaaggcacttaagaaaaatggaccaagtactttctcatggtacctagattgtgaagctgaacaaagctgggtggccacttttgcttcttaggtgtagaatctctagtatttgggatacaacaacagaggagtaagttctaaagtttcaaaacaccccagaactgtagtgggggccctccttctgtctcatggaatgcagcagatgtgtgcatatgggcctctccacagcccctcccccgatgcctggcttgggaggctccatacttgtcctggtgaggatgcccaccaaactttcttcccctccacgaggaactcccactttttggcccctctgtttgttatcagagcaggagctctgtaggttcaaggctgagcaggtgtcctgggatgacagaggcttggctggaggaccactgccctgccacttacccagagcatgacatcagctctctgagggtaatctctaccaggagtaccacccttagatctctggctttctaaggttctgtgaggtcaggtgacaagagaacctggcctggctggatatatctggataatttcatgacttagtagtgccaatgggaatgatgggcacaggtggtatagtggctcaggtttggctctttggagtgcattttaatcaggtcatataaaatacacgtaaatgactatctaaataacaaaaagatctttttcattccctgcagaacacagcttcctttcagtttaggaccttcccatccccaaaccattagcatgaccatggcaagcagctgagacaatctgggttctcaatgttatccttgtgtccctagtggagacacaggtaccacagagagatgtgaagccctccatgtggtggttgggagtaaaaggggaatggaagagagccttactaatggaaaagatccaggaatcccccaaactgtccaaatatctgttctttaaatcttctgtaggcctaccatctcttatttttctttttgtccttcctcccctcatcccttctcttcttccttcctgccctcctgcccttctctttcccttcctgccccctccctctctattccttccccattccctttccctttccctacctttccctccttctgtcattctttccttctttactttggaatatgttgagctgaacaactgtaatctctattactacgccctctatatcttcttgggcagatgctaagagtttttttgtgaggaaagtcacaggactcttgaaattcctggggcccagccttcctgtaggcctgtcactttaattttttctttcattcagtcatccatttattcaattattcaagtgagatgtgttgtgctgatatggcacaccaggcattttgctatacacaggagagttataaatgaataagatttgttctctgttcttgagtagctcacagtgcagtggggcagacagacaaataacaaaataagcatgatccaatgtggcaagtacaggaatgcaggtgtgtggaatgtccttgggctcaagttcagaccctttgggtttcaaaccccttttacttggagtgactctgtgggggaaaatgtgtctagatgttgccacatgctatcatttgaggatgagatcactggcctttgacaatagtatctgtgcaagtagcaggagcagaggtataaatccttgatctgtctgtgggcagccagccaagatggtgataccaagaggagctaatggaacccagctcatggaacctcaccaggaggaagagataatgctgttgctaaggagaagagagctgagggggaccctgagggatctaagacaaagtggagggggcaggataatgggcttgttcagagcattcattttggactcagacattcctgagtttgaatcctgcttccccaggtagcagctggtatcaaggtgggaagctataaagtgataagaggcacaatggaccaaagatgtgaggggcaaaatcagagaaagagacaggaagtctatagaggctgtgaggacatggtttacaaattaaagtacatctgagggccattgtatcagtatcttagtgactgtggtatttactctaagagctccagagtagtttcagggagggagtgatccaccttagttggggtggctaagggaaattagctgagctgtgaataatacttcatggatgtagtgatgatgaggccaacagtggggaagcttgtgaacactgaatgggcagtgattgaacaggatttagcaaattgcaattacataagctatgtagtattttttccattgcattttatataacattagagatgcattgcctctgaaacaccacctttaaaaatgggacaaatcttttaaatcaaaaacacgaattaaaatgatcacaaaatgttactgtcttttataaacgttgatgaaaattttgtgtctggttatcctgttacagggaggcgtataagtgatgaaatctccattagatgatgaaatagttaatatttgtgggatgaaaagtgaccctgtgagaagaggtttattcacagggctgtggagagagggagggagatggggaagggcatgaggagagaggcctgcttgtgcaataactttgtccccttggtagtcatgatttatcctttcttctttcttggctgttgtcttttgatgtggaagctagaaaacacttgatgccctttccttttgtcaccaccaaagccactgtctcagagcctcaatattttgcctaggctgagtgtcttctctgggtttattaaataaacaccagtgtccactcacctccagaggctgagaggccaactgaggagaaggccactgtgattcactctgcgatgcatgcaaaatcgggaactgtctcctttggaccagttttgaatgtgaggtcccaaaagacagaaatttgtctctctgattccttattgtgtccctagtgcctacaatcaagcacataatcaatgctcaataaaaatgtgtcaagtgaataaatgggtccagggctcaggacttggtattgcccagatgcagtttgggactttgtttttctctgctgctggaaactcccttattgggctccatttttgagaggtccttttatacttctttatagattcccaggatctcattgatttgccagcaatgttgactctgctccattttctctccactcagattcgatccaaccatagccagaaccccgtcattcttcagtgtagtggaatgaggtgttctgggcctccaaccttgttctgcagcccctgacaggaggcaggctctaattctccagttttgtccagcctgtgtcatgctgcttccaggtctgcacagagatgctgggtctgcatgtgggtatcactcacattccaagtgtggagctttgcaggctgtatcagccatggcacactcttccctgggggcaggcctttcacccccttcactgtccctgggtgagagctctctagtgatttcaaaccgaacttaaaccaatggcccaaagctgtgcctcctgcttcaatttcaacaaatttctctctttttttaaatacctattggtgcgtatctgaatatctgatattaaacttctctcaggttctttttttttcttatttttggaggtggagtctcactctgtcacccaggctggagtgtagtggcacaatcagctcactgcaacctctgactcctggttcaagcaattctgcctcagcctcctgagtagctgggattacaggtgtccaccgccacgcccagctaattttttgtatttttagcagagatggggtttcaccatgttgtccaggctggttttgaactcctgacctcaagtgacccacctgccttggcctcccaaaatgctgggattacaggtgtgagtcaccatgctgggcctcagggtctttttgatccctaaattttaagaattaatttataggatttgacaaaatccttttttagttcaatggacttataaggttatccatctttatttttaatgccccccctccacctgctctacttagccctcacatcaacttctcttagtatttgtaatttgactgtagctctacgtgacacttctctggttttctggtagtcaaagtgagatgttactcttagttcacataaaaaaacattccttcaaccccaggagcatctcagtctcacaatttaggccaaaacatgtgactccattgaagttgtaacttccatgtgttgatgtcaaggtcgtgtagttacaaaattaataatttgttgcttctttggtatatctatttataattccaggaacacttctcattttctgcctttttctttttcctaaaattctcattttgcacattccaataatctcattgagtaaactcccagccacatctctgctccattatctcattaatttaagcacctctctcagctttcatctctctccctggattttcagtcactgagttatacttcttcccaaggcttacatctcttccctccatcttttgattctgcttctcttctgcctattttctgcttttttgccttttgatttccggtttcttagttagcactccagaaacagctcatcaaaacaaactagtggtcttctgtcatacactggaaattccccaattgtattaatgtcctctcagattttacaggaaaagtcaatttttgcactgataccctctttgagtttgaggttgagtttcagggcctcaaaccagcacaacctgtgtcgttctctccctcccactacaacataaaactctccccttcccttccatcagtggagcggggtcggatccactatgttttcctggtgcagagataaggtttggctcctgagctgggttgtactgaccaaagagctgaggagagagactgtgaaatgcccagtgggacgctggtggtaatgaggacaaggaactttatcttttttacgaggttgggcacaagcactgccaatccttggcaggtacaggggtagggggacatatgacatcctgtacataaaacaagaagtgccttctggggagagctcagatcccccacaggaaaacctccagctcagcctgtgaaagtcagaagagggtatatgggaaggcatgcgtcagatggggctgttcttggcctcttgggattcttgtttcctccaaagatcgcttgtctcagcatcaggatctggatcagcagcagcccccagaaccgtggcagcagccagagcccccgccttgctgaccactgcccctgtcacaggagttggacctctggcgccggcatcggtggtggcgcctgtggtggttcaggaagcagccgccctcggagctagggccacagcccccagagcttggggcacagccagaggaagctggaggcagacactgtactgggttctttgggggacacttgggtgaggggcacttgggtgggggttggcactgcttctggttctgctggcaggacatcttggcaggagttgagatgtcctggagaaaacgaagccacttcttagttcaaaatctacagtccaacgtctctaagaccagctgcctcctgaggcaagagctgcaagagggtgagggaagctgatgtggagctggtgggatatgccagatacttctcacattgctctccacccgggacagattgctgtgagtctaagtgggcacgtgtgtttctgtttctccaaagaacccctagggaatgcacccttttgggaaaaagaattctgtagaatggatgttacaggaaatgtgcctgcctgagtagaaagaggatgggagggaattgtgagctctgtggcctttgcaggtcatggaattgctgtcagttcctgcagggtctccctcctgcccccttcccccattgctgccctctcacagtcctgtatctgggtctttgtttcaaacctctctgtttccatctcttctgctatggccttagctttctgttctaacatcccatatcaagccctgtcccctgctgaatacttaccaggtgcagagaggcaggagaaggctgttcctgaggagactgtggaggagcccagggcaggagtgcttttatcctgtgcagggtgtgtgatgcacaggctgggcatgctgctgctttcacaaccaggggaggtgacagccaggcacacccttgagactatccattcatcaccttcctgtgtactcaccaagatgcctgacaagagggaaccaggaaggtctgacgcctgtttaccttcacctcattcaggcctgctgggggttgcaatcctaccttccttgaagcaattgtttttatcaccactcattagtagtcactccttattccacattgcccctctggcaactagtaatcaattttttgcctgtatggacttgcctattctggacacttcatataaatagaatcatataatatatggcattttgcattagcttctttcacttaatatattgtttaagatttatccatgctgtagcatgtgtcagaactccattcttctttatggttgagtaatatttcactttatgaatttagcacgttttatttaaccattcatcaagtgatggacatttgagttagctccaatttttggttattgtgaataatgcagctacaaacttaatctttattatttccttcctcctgctttatgtttagtttcttctttttttcagtgttttaaggcagaaggttaggtaattgatttgagatttttcttcttccttaatgtaggcatttgcagccatgtatttccctgtaagcatttcctttgctgtatcccataatttttggtatgttgtatttttattttcattcatctcaaagtattttctaattctccttgtgatttctttctgaactcattggttgcttaagacatttctgaattttccagttttccttctgttattgatttctagtttcattctcctgtggttacggatgatactttgtatgatttcagtgttttaaaatttaatgatacttcttttatgacccaacaaatggtctaccctgcagaatgttccatgtgcaattgagaaaaatgtgtattctgctattgtggttggagtgttcaacaagatgtctgttagatttaattggtttatagtgttgttaaagtcttcagtttgttgattttcttcctagttgttcttccattaatgaaagtggagtatgaaagcttcaagtattattgttaaattgtttatgagttgtctgtttctcccttcaattttgttagtctttgttacatgtaatatgggactccattgttaggtgcatatatatgtataataattatttctttaatagatatggatccttttgtcattataaaatgtcctctttgtctctgccattaatttcgtcttaaagtctatttcgtccagtattgtatagccactccagatctcttgattaccattgcatggtgtatgtttttctaccttttactttgaatctattttgtctttgagcctaaaatgtgtgtcttatagatagcatatagttagttcatgctattttatccattttgccagtcttagccttttgattggggtatttaatctattcacaattaatgtaattactattaaggtagaatttatgtctaccatttactatttatttcctatatatttcataactttctttgcccctctttttcttcactatggctttgttttttattgaacaggcattttctagtatacccttttaatttcaatgttatatattttagtatattttttgagttattttcttagtggtttccttgggagttcttattaacatcttaacttacagtgattataactcagatcaataccaacttaattttgatagcacgcaaagctttgctcctgtgtaggtttgttccctcccccttctgtatactgttattgtcatataaatcatatctttacattagaaggccatcaatgcagttctataagtatttctttatgcagttgtctttcagatcaaattggagaaaaaagacttaaaagcacaaaatgcatttatactgtcttttatatttaccatgtagttaactttacaaatgctcttcgtttcttcataaaaatttcaaatactctctagtgttatttcatttcagactgaattaatccttttagtattttttgtagagtagggtttctggaaacaaattttctcaatttttgtttatctgggaatgtcttaatttttggagaatagttttgctggatatagaactcttggtttactttttttttctttagcactttgaatgtgttatccaactggcttctgtcctccatggtttctgatgagaaaccagctgttaatgttattattaattttttttgtatatgatgggtcttttctcttttgctgttttaaaaattctctctttgtcttttgacatttgtactatggtgtgtttaggtgtggagaggtttgactataccctgctaggagtttgttgatcttcttagatgtgtagattaatatttttcatcaaatttgataagtaattaactgttattcctttgaatattcttcctgtctttttatttctctcatctcctcctgggattcttattataaacatgttggtgggcttgatggttactcacaggcctctgaaggctctgttaatttttattcaatcttatttctttctgttcctcgggttggataatcacaattgacctatcttcaagttcactgatttgttcttctagttcaaacctgctgttgagcccttctagtcaattttaaatttcagttattatatttgtcaagcctcaaatttctatttggttgttttaagaaattctttttaattctttgttgttattctctatttggcaagacaacattcttatgttttcttttaattcttaagacgtagtttattttagtactttaagcacatttaaaatagttgatttttatctttgtctagtaaaaccaatgtttaaacttcttcagggacagtctctcttgactacctccctggactttgccccttgtgtaggtcatactttcttgtttatttgtagctttctttcttttttggttaataattggacatttaaaatgatataaaatcctggaaatcaaatttcccaaccctctctggggtttgttgctgtttgttttcactgtccatttgcttcatgactttcctgaaccaattttgtaaaatctgtattctttattgtgtgtagtcatttaactctgtactcagttagcttagtagacagagatttccttaaatgccttgagttaatgtctttcaacctttgctgaggacctctgtgtgtatgttggggcatgttttcaagacttcagaagacagtttacaaatctgtcttaggtttcatttcctgcttggatggaacttcaagatcagtcaaagttgagatattagggtcttcccaggtcttttctgtacatgcacacaccctgtaagtccacatagtctcctagatttccagaaatgtgtcatagatttttaaaactctctatgagaatctcattcctcagattttccatctaagtttttggtcaacttctgatttgcccaactattatcaccatcacaggcagctgtgatgctaaacattttttactgattgtttttggcaaacaccctggggtaaaagctgttttcagtgagagagttctgagtcaactggaatgaaaacaagcttggctagttgggatttctaggggaaatgggaatgggatcttcattatgtgccatatagtcagataatgacatttctctagggatggggtttttggatagtttcagatatgttctgttacctccatgtgctactagcattttagatttcaagactattatggcactgggaacagggagatgataatagggcaagttaaaatgtcacaaagctcactgctcttacccatattcaactgcttttcttaagtgaacactctaatatttttgcaagcctttggtaaatctccagagttttgcaaaagttgattttcacaatttttcattttcaaggtgtttttaatggaagagcagatttttggagatccttgctcaatcattcccaaccttgtcttcttaagtgaaaacatgagtccctagtttttcatctgggtcacaaacttcacatccaataagcattattattttgagatatacagctcttctcatcaccacagagatgcttccatataatatccaggtcatatatgagaaagtaagattaagcttttcctgttttattgagatttgacaaaaataactgccaacttgtaaacaataggcacaaataactctccaccttataaagaggttggaaggagccctgagatgctatcactcttctcttgttatagtaatgagaagttttcaaaactggatagaatgctgtggattttccccttacatttcacatggggaagcaacaggttattactcttaccctccactagaggaaaagtcatagaaatttcaaggggacaaattgtagaacttatcaatgcctaaaaaacagaaagacttggccagtagcggtggctcatgcttgtaatctcaacactttgggaggtgaaggtgggtggatcacttgaggtcaggagttcaagaccagccttgccaacgtggtgaaaccccatctatactaaaaatacaaaaatagctgggtgtgttggctggtgcctgtaatcccaactacccaggaggctgaggcaggagaatcgcttgaaccagggagacggagtttgcagtgagctgagattgtgccactgcactccagcctgggcggcagagcaagattccatctcaaaacaaaacaaaacaaaacaataaaacacacacacacacacacacacacacgcaaaacccaggaagactaaaatttcaggtctcagtgtcatcattggacttgctgaacagttctctggctattctggagagtgaaaaataattggaaagggaaaatggaaaggagaatggggaaaagagaagcagccagtcccttactgcttgacatggccagagttcatgagtttccctgagccagtggacagtttggagggcagctaggcatagctgtactgccacagtcctgctgggaatgtggctatcaaggcaagaggcctgtaccaatggggctaagagtgcaggggagtgtcaaaagaggccaaatttttcacatcaggtcactgtgctaaaggttccttaaagaaatcagtcatttatctggtaagagagccctcatgggtcagcacagagaggatgcagccactgagagacactagcagtaccagccaaatatgagatatttgctttgtccccccttttctcattccggcctcaaaacagtgcagaataaagggaacccgcaggggagaggaggaggtggacaataaatgatggaactaaccatgtctcttttccacacactagatgcctgttttccacacagtcctttaggagacagttgggctgtgctgggttggagagggaggagttaatattcttattctgagttatatccaactggacaggataggatgcttcctgaatacctgaaaaatgattagaaaggcctgaaacacacttgagatattatcaaagtagagtcagtataacatagtagaagacagagactagaggaaaaataagtcactatttgtatctgacactgagttcagactacttaataaacttcagaggcccttggaagattttcctgccaaggatctctcttggttcttcctctctttccaatatcagtcaataaataaatcaatactcaatttcataaattgcataatattttttaaactgcatttaggaaaacattccttcttggagctaattatcactgtaaaatcagggctttgtggtgaaaaatgtgaaagacttcagatgtcaacaatgaaaagttttgtctccaaactccatgtcaccctcaaaaccttcagtttctgtgagctatcttgggtggtctgtgacatgatctttctttactcttgagctgggctccaattttcagtacaggtcatggtgggcctggagtgctgaggaatgggtcagacctccaatcatccagggggctttgagttgctaagagtggtgtagggaaggcagataaagttgaagaaagttttgttatttcagaaagtcacatatagaaagaggagatgggggtcggggaggtagggagaagatggatgccaggagatcagggagggtggaatttctggagagaagagaatcctctacctcagaagttctcagctttggctgcacattggcatcatcttggagggttttttaaaaatacaaaactctgagtttcatccctcaagacgctggttggcttgggctaggcatcagggttttagtatctcccaggtgattctgatgcacagtcaggtttgagaggatcagatcacatgaggtggaagagaaagaattggaggttggagaatgagatcacctgtgggcttacgtgcatacgtacctattgtccacaaaacaaacaaaaaattctttggctacagtactagtctctggctggtcaggaactggctgatttctctagtctcaacttctactatcctcttctacttctttacctgtctttgtcacaccaaggggtctgaggcttctccctgggcctgagctggggggcaccttagtgactgaagcttggtgctcagggagtgtctgtctgaacaccttgaggaaagaggcagatgtctcaggaagttctagttcatagactctctggacaggatcttgttaccaggttctatgttgcttgcttataggctgcagggtcctggtagtaggcgggggggcgggaggtgtgggggaggaaagagtaagtttttctaagagaaggatctgggatgccccaagactgtccgggtacctatttcttaagtttgtttttggtgtgttttcttctctttctcccatcctcttttgctctccccctctctttacattccttctttactttcttctattctctaaaaaatgaacagatattacacagtgggcatggtgatagatgtgcaatccattggatggtggacacacctaattataaataaatgagatgtggttctggttgagtagctcaccttgtagcagggcagacagacaggtgatcaaatgactatgacccaagatgatgaaagctacataaaacatgtgttgagtcctgaggcttatgcaagagcttttggctatcagtctcctgtctcctcagtgtgcccagaggttgtcatttggtatcacttgagagtagttgaggtgaggtcagcagcctataggagctgatgatgggcatggagcaggaacaaagggataaggagtctgacctccccttgcagtttatggtcagagagacacagagaaactcatgaaacctaggaggcagaggtgtccctgcagagagaagggggatggacaaaattcctgtctgaggacagaatgtggtggatagaagcggccagaataataggttcattaagaacataggttggggagtcagatatttcaggctttgttttcttatttcttcaggtgatagttgtcataaggtaaaggtgtttgaagagagaaaaaactacaatggaatgaaagcacagtggaccacggatgttagagctgcaaccagagatggagataagaaactaacctacatctgatgaacgatgtgtcagtaagccactcactttgtaagtttctgagttgcagacatgggtcagagaagaaggtgattcacccaggctgggatattcagggagaatttatctgaaaggtaattataattaattgaaggtgaataattatagatacattttgtagtgttattatgtatacctgatgtaatgcaattgatgtgtgactaatgcctgtaaaaactgcatttgaatcagctctgtagaattttcctattgcattttattataacaataaagacgcattttcttctgaaatataagcatactcaagaataagacaaatcttttatatcacacaggtaattaacaatatgtatttttttcagacaaatacaccagtggttcagaatagaaagccaaaaaataaggccacacacctacaaccatctggtattcaacaaagctgacaaaaacaagcaatggagaaaagactcctagtcaatacatggtgctaggataactggtcagccatatgcagaagattgaaactagactccttccttacaccatatacaaaaatcaacttaagatggatcaaagacttaaatgtaaaacccaaaattataaaaaccctggaagacgactgaggcaataccattccagacatagaaatggacaaagattttatgacaaagacaccaaaatcaattgcaaaaatgacaaatgggatctaattaaactaaagagcttctgcacagcaaaataaactatcaatacagtaaacagacaacctacaggatgggagaaaatctttgcaaactatgcatctgacaaaaatctaataatatccagcatctataaggaacttaagcaaatctacaagaaaaaaaacaaacaaacaacccaattaaaaagcaagcaaaggacatgaacagacacttttcaaaagaagaggtgcatgcagtcaataagcatatttttaaaaagcccaacatcccactgatcattagagaaattcatatcaaaaccgcagtaaggtatcatctcaaaccagtcagaatggctgtcattaaaaagtcaaaaaatagcaggtgttgtaaggttgcagaggaaaaggaatgcttatacattgttgacgtgagtgtaaattagttcaactgctgttggagacagtgtggctattcctaaaagacctaaggaccaaaataccattcaacacagcaatccgttactgggtatatacccaaaataatataaatcgttctctcgtaaagacacatgcacacatatgtttattgcagcactactcacaatagcaaaaacatggaatcaacctaaatgctcatcaaagagagactggataaagaaaatgtgatacaggtataccatagaatactatgcagccataaaaaagagtgagatcatgtcctttgcaggaacataaatggagctggaggccattatctttagcaaagtaagacaagaaaagaaaaccaaacactgcatgttgtcatttgtaagtggcaggtaaataatgagaacacatggacacatagagaggacaacagacacagggacgtaccagagggtggggaatagaaggagtgagaggaccagggaaaatgactaatgggtactaggcttaatacctgggtgacaaaataatctgtacaacaaatccccatgacataagtttacctgtataacaaacccgcacatgtacccctgaacttcaaataaaagttaaataaaaatgcacggcttttgagaaaacattattagtacagtaaatgtgtctgtttatcctactacaggaaagcctatagttgtggctacccactttgagataaggtctaacaggaggaaaatgagagtaccttcatactactggtgcaaacattattttttccactggcagtggtctgagaacataggccttctagtgcactaatattcttctcatcaccactagcaactcatcccttattcttacttgattgctgtctgtggtataaaagtaaggtgttactacatgagctttttgcagtagcaaagccagtatatttaatcatcaatgttgttctcaggctagtgtctttcattgtgtttatcaaagctacactgctgcctcctcaatccagagatatgggaaaccaactggatagaggggtgttgataccttactttgctgttttacaagcaaatcagaggactgtcttgaatggacccactagattggaagttccctgagaacatcttattttttcattttctctaatgtatctccagtatctatagaggtgtcagtatataatagatgtttaataaatagtttttaaataatgaatgattaattattaattattgaatcctaggctgggttgaggtggtctttattagtgacctgttggggtccacttttaggggcagcatcatgaactgcataacatctatctttgactgtcttggtattgcaggttcaaacttcataagttggtccaactcctatttcttctccctcctgagtggactcacagtgggtgtaagaattggcggacaatttgacatcaagagcttgaccttggtaggtgcttggagcctccagtcctctttccatagactttgatggcaggctttatttcttcaaaggctggatcttttctctttcaggtgatatgcagttaggaatttgtctcatgaattctagtcctgctctaaacagtggtcctcagtttctggactagtggagtggttctggctagatctgtgggctccttggtgtggggtccatgtggcaaggcctcacacacagggtagcaactccaacctcccaaccaaccttatgcattctcaatatttttgagacatatttgaatcatgacttgacactgtttctgtcccatggtggagcgctacccaagaatgtctccagttttgagtaacaagcagcttgtggtgatgaatcaaacaggacggctgtggttcctactttcagcaactgtgctgagctggagagtaatcagaactggttagagtatttctcacatcagactccttgagagcccttttctttactaaatttcagagattttagaaatcctgagttcttagactttgcagtaaaaataaataggcagtttgacgttttcaaaaggatatttttgattcaataaactcctaatgttttatctatatttatttatttttgcttgttgtacccagctccacacagagttctcccacattttcaatttgtaatttaattcatgtcctgtggtgttcctttggcttattctaagaactatatgaatggctttgatgaactgtttctctaagctagtatttcaacaatctgacagacagagagactcatctctaaggaggtaattcagcctagagggcggttaagtatcacacatccaaaacatgacagagaaaaatttttaaaaagttttattgaagttatgagtcacatagttgggctcttagctctgcagatttaaaaaaatcaaacaaaaataaaaacaaaacacgaagttaaacaggacaaaataaatgtaaagtagaaaatactaattgtttctaaagatctcttgaaaagtctccagggagggacaagtggcatcagcgaggatcacggacttattggctgggtcctgtgcagaactgttggacccacaatttccctgtttgtaaaatatggttattaagagcacctggcttatcgagttagaaaattaaatgagttcatagtagtcacttagggttttctagcacctaataagcaaataagtttttgatcttacaattattctaatttataagcctagcaatacttctcattttctctcttcctttatcttaatggtctcagtccacaccttccacattactacattccctaagctctcagctccatttctcccctgacccaggacttcttaagctttaattaattctactccctccaccttctctctctgaagatttaattgtgtatgtggagttatctgtttttcctgagaccagctttttcttttttcttttcttttctttcttttctttttgaaatggagtttcactcttgttgcccaggctggagtgcagtggtacaacaggctcactgcaacctctgcctcccaggttcaagcaattctcctgcctcagcctcctgagtagctgggattacaggcatctgccactatgccaagctattttttttttttgtatttttagtagagactaaccatataacatgtggtttcatcatgttggtcaggcagtctcaaactcctgacctcaggtaatccacttgcctcagcctcccaaagtgctaggattacagacagctgaggccatgtttttctttacccatcttttaattgtagtctaaaggttttcagccttgcaattattggacttcttggggcagataattctccactgtggggctgttctatgcttagtaggaggcttagctgcatccctggcctctacccactagatgccagaaattctctttctacctctaagttttgacaacaaaaaatgtcccttggagagtcaaatttacccctttagaagaaatgctaattctgcctatttttttgataattgcctgctacatcttcactgttttgtaatagagatgtcagaaacatctagtagctagctcctcctacgactggggagtccattatgagaggacaatcacatttcagtcattcttttctgacagttagaggcctcactacaacccctctcatcacatcctgtcccccactgccgcacaattccagcagaaaaggactcgacagattcctgaattttgcagacctagagctagaattctgcatcttccctgtggtggtgctggatgtcaggggcagacaggagggcacacttccagccccacctagggagagacagagtgaaatgccaagggagacaccagtggtaatgaggacaaggagctttattttttgatgaggtcaggcacaagcactgccaatccttcacaggtacaggggtaagggaacatgtgacatcctggacatcagacaggaagtgccttctggggagagctcagaccttccacaggaaaacccctagctcagcctgtgaaagccagaagagggtatctgggaactcatgcatcaagatggggttttcctgggcccttgggattcttgtttcctccaaaatcgcttgtctcagcatcaggatccaggtcagcagcagcctccagagccatggccgcagccagagcccccgccttgctgaccactgcccctgtcacaggagttgggcctctggcgccggcatcggtggtggcgcctgtggtggttcaggaagcagccgccctcggagctagggccacagcccccagagcttggggcacagccagaggaagctggaggcagacactgtactgggctctttgggggacacttgggtgagggacacttgggtgggggttggcactgctgctggttctgctggcaggacatcttggcaggagttgagttgtcctggacaaaacaaagccatttgttagtccaaaatctacagtccaatgtctctaagaccagcggcctcctgaggcaagagctgcaggaaggtgagggaagctgatgtggagttggtgggacatgccagatgcctctcactttgttctccaccagggacagattgctgtgagtctaagtgggcatccatgtttctgtttctccaaagagcctctaggaatgtacccttttgacaaaaggcattctggagaatggagatcataggaaacatgtgccagcctgagtagaaagaggatgggaaggaatcataagcttctgtggcctttgcaggtcatggaattgctgtcagttcctgcagggtctccctcctggccccagttcccacattggtaccctctctgccatcctctctccgggcttttgtttcagatctctccatttccctctcctgctatgaccttagttttctgttccaacatcccaagttgagtcccatcccctgctggacactcaccaggtgcagaggaggcaggagaaggctgttcctgaggagacggtggatgaggagcccagggcaggagtgcttttatcttgtgcacggtgtgtgatgcacagcctgggcatgctgctgctttcacaaccaggggaggtgtcaacaaggcacacgcccaagactaggtttgtagctttggcacttccataatatccaaccaatgacattgaacctggaagcaggatcactgtccacatacctctcacctgggaggctaccactgcttcttttcttcctcccttcttccttgtttcaactcacgtgctgtggagcacagtctgtcctttacaatttcctgggaattagtatgacataattctttcttgagtcatgactggagaaataatagtcatttcaacaaatagagatgaaataattggacgtccatatgtaaaagaaatcatacctaatgctagatataaaaattaatagatcataatttaaaaaattaaactatgaaacttctgcaataaaacataataaatctttgtgactttgggttatgcaaaatttttcagatatgccaaaaaggtacaattcaaaaaagaaatataggacttcatcaaaattaaaaacttctgcttttcaaaaggcactgctaggcaaatgcaaagaaaattcacagacttggagacaatattgtaaaacacaaatcttaccaaggacttggttcaagaattttttttttatttttattttttgagacggagtcttgctctgtcgtccagactgaagtgcagtggcgcgatcttggctcactgcaagctctgcctcccgggttctcgccattctccctgctcagcctcccaagcagctgggtctacaggcgcctgccaccacacccagctaatttttttgtatttttagtagagatggggtttcactgtgttagccaggatggtctctatctcctgacctgtgatccacccgcctcggcctcccaaagtggtgggattacagagccactgtgcccggccaatgttttttaaattctcaaaaataggtaataacacagaaaatatgggcaaagtatttgaagagtcattttaacaaagaagatatatgggtggcagttaagcacatgaaaagatactcaacctaatcagtcattagagaaatgcaatttaaaagcaaagtgagataccactctatacacattggaatggctaaaatgaaataaatgacaatatcaagtaatatgagggatgtagaacaacaagaagcccaagtcattgctggtagaaatgcaaaattacattagttggcagtctatcaaaaaaattaaacatacaacttacaatttgccccagaaatcctattcttagatatttagccaaaagaaatatagttgtatgttcacagaaaaacctgtagcccaacatttatagtggctttattcataactgccctgaatttgaagaaccccacaagatcttcaactgatgaatagagttttaaaaatggtatatttatgcaatggaaggctacttagcaataaaaaaggaatcaactactgatatataaaacaacagggatgaatctcaaatgcaaaagaagtcagactttacatactacatattatataattttaattatagggcattcttgaaaaggcaaaattataagaactgaaaataggtcagtggttgccaagggctggtatgagggagaggctgatttaataagcagatgagggaatattttgaggtgatagaactgttgtatgtcttagttgttgtggggtttacctgactatatatgttagttaaagctcatagaattggataattaaatggatgatattttggtatacaaaatctcaagaaatgaaacttaaaatagaaaaaacaattaaaataacaatttttagaaataaaaaataatgaaatataccaaaagggaagcaaagaatgatgaatacaagatttaggatcatggttatattagatgggacaggcagggacatgggtgaaggctgaattacacaggtgcatataatttactatcaaagttatcattttcgcttggatggtgaatttttgtgtgtttgttatttaaataatagacaaacaggtaggcacattaattaagaaggccaagcatggatgaattgtgagcatataatatgaacagagggtatttgttaatctaattttgtgcttctgaaatccaatagtaagaaaattaaatgacataaactccacgacaacttggacaacttcccaagttgccattgatggcttgctcatctcatcttccccaagaatgactcagctgcttttcatagcatcagtcatatattgcaaaggagaagggttgatccttggttggttgtttgtccactcatttattactaatatgacttctcagaagattcaccctggaactagacctcagataaagcacctcctggcccagagtcaacatgcttgttattaggtcataacatcctcattttgagccagtcaagtaaatttcttcttcattatcccaggtcctcaggatgtcagggatactaagaagttctcacagtgcagaacatttggagctgctccatgctctgagagaagtaactgggctgtggactgtgttctgagaagaacaagtggttggagatttcataagagatgtgtgagattaaggagttccatcccaagaagaaaaagaatgtctccaaattaggatatggagacagaaactcagaaagggacccagtggtggagctaagaaaaagccagctacaagtcagctttcaattcatgaggaaaggtggaccctcctgctgacaagttctgaaatgctttgagtcacactgacaggcggacatgtgttatactcaaaatgaagtcttacagcaattcaaagttgtacatcattaggagtaaatacggactctgtacttatttctggacaacgactgtacatggaaaagtaattattcacttctgaagctaggtttgaactccaagacaaagacagttctctcacccacactataatgcctacattttgcctttgggctcagtcatcacagatataaataccatatttgtgtagtgtctatcttctctgctaggttgtaagatccctgaagaaagtaaatgtgccccttattcagtgctgaaacccaagctgagcaagccacttactggccttagcagatattcagcttgtgtttctcaaataaaggatgatgagagtcaattccaacatgtaagattggtgatggcatgtcggaaagagagaggctcagatcaaactttgggcttgagaagaaaagttatagagtgatgtctccagtgagggttgcagatcaggggtcagggtagacccaacagggcatctgggactctctgggagcaccctctcactcctctcactcaggctgccccattcctgttctctaggttttaggtctgacaccactggcattttttccgatattttttttccactctcttggttgcttttcagcctcaccatccagtttgacataaaaaagcacattgcacctgttatgggacagtcactagaagagctaatggctgctctcagtgcagcagttaagctgaaaatgcaaatacacctagaaacccggaagggaatgaggatcttatgttgaagaccgagaggacttttgtatatggggtgagataagggtccagtttcattcttctgcatgtgaatatctagttttccccaaaccatttatttaagaaactatcctttttccattgtgtgttcttggcacctttgtcaaagatcagttaacaggaagtgtgtgtgtgggttaatttatgggctctctagctctctattctgttccattgatctatgtgtctgtcttttttttttcatgctgttttgattactggagctttgtagtacatttgaaatcaagtggtgtattacgtccagctttgttcttttgtccttaagattgctttggctattcagggtattttgtagttccacatgaattttaggatttaaaaaaaattctattttatttttcaagatggtatattggaggctttagcatgactcttccacttggaaatagcaaaataatgcataaagatcaaaattatggctttaattcaagaacgaaaatgggaattcactggaaagcaaaagacatcacagttcctaaggaggcgaaaatgggcaaacaacccttgttatagagtccagctgaaaagtgagtgaagccccaatatgtgagaggggcacacattatgacttagctttctaatggggatccatgcaacccaggccaaaggagagcatcatatttctcccatgccctggagctagcttgagaagaggttgggagacactgagagggaaagacactgggaaaagctgcggagattttcccgaacccagtactgaaagcaggatgccatttttaatccaggcacatacaaagtcagccattctctgatgacttggcagtatggctgtgcaggcattttagtcttgggccagagagtggagcacttaccctggagtagggtaggggtctctacagccataatctaatggcaagtgtggaaagtgccccacaagtaggtgctggaactgtgttctcccctatcaccgcagtaggagaactactgcagctgctgtttcttctgggtggtaagacttgcagccagggccacctggtgtggagacccggaattagtctgtatgtgtcattcatgggtgctccagcctgctcccctgagactgtgctgcagcagggcaatttctgctccatgctcccacagatcttcagacattcaggactccacttgtctggatcagcagcctgagctgccccattcttccagtgcagattgtggtaaagcagggccctctatgctttatgcctaggcagatattcaggcatctggagcacccactctcctggattaggagttcaagctgccccccaacacttccatgcagagaacttggggccaaggaggtttcccagctccaggcctaggcaccccactgggagcctttctcccttggtgctggtgcttgtgcctgccattggaggatctgttaggtgggctgcccagtgtggctctacccatctttgtatgcccccaaggactgagcagggagctcaaaccactgagcaccccacagatcagcccattgcctgaggcaattcagagcttctgtccgtaaacaagtatcaaatatatacctatttgcattgaccactgctggcttttactcataagcaccatctactggcctgtaggtcaaactgatcagcccaaaataaaacctgccaatagaagtgcctagggcatagggctacagaagtagtcaaaagaccctagccaacattttctacagtcacaccttctagggaggaagggggaaggaaaaaaaaaaaaagaacaaatcaataaaattatagggaaataaataaagaaaaaatcttatccacatgaaaatatttacatagaagtgctaggctagcatcaccagatgagaaagaactagcacaaggactctggtaccatgaaaagtctgaatgttgtgacacctccaaaagatcttcagcaatggtccctaaccaaaatgaaatctcaggaattacatataacaaattcaaaacatgaattgcaacaaagcacaatgagatcgaagacaaggttgaaaatcaacataaagaaacttctaaagcaatgcagaaaataaaggaagagataaaaaatcttaaatcaatcagagattctgaatttaaaaactcacttaaagaaattcaaaatatgattgaaagctttaccactagactagaccaagcagaagaaagaatttcactggtatgaataccaatcttttgaactaatccagtcagacaagaataaagaaaaaagaatttaaaaaacgaacaaagtctttgaggaaggatattctgtaaagcaaccaaacctacaaattactggcatttccaagaaagaaggagaaagagtaaacaacctggaaagtatatttgagggaataactcaaggaaattcccctcatcttgctaaagaggtagacattaagacacaagaaatatagagaatgtgtgcaagatactatacaaaacaaacatcaccaaggcagatagtcaccagactgtccaagattaatgctaaagaaaaaaatcttaaaggcagctagagaaaaaggtcagaccacatacaaagggaagcccatcaggctaactgcagagttctcagcagaaaacatacaaatcagaagacattgggggctcattttcagcatccttaaagaaaagaaattccaaccaagaatttaatcccctatcaaactatgcttcataagcaaagaagaaataaaatcttttccagaccaatgattactaagggaatttgttaccactagactaaccttacaagaaatctttaaaggagttctaaacatggaaacaaaagaacaatacctggtccacaaaaacacagttaagtacatagcttgcagaccccatgaagcagctacacaatagaaactacaaagcagccagctcacaacttcacaatcaaaacttcacatatcaatatgtgggcttgagtataaatggtctgcaggcccaatttaaatggcacagaatggcaggtaggatgaaaaagcaagacttatccatctgatgtcttcaagagacccatctcaaatgtagcgacaattataagctcaaaggggttggaaaaggatctatcatgcaaatggaaaacaaaacaaagtgggagtcaatattcttagataaaatagactttaaatcaacaaaaactaagagaaaaaccaaagaaggcaattacataaaaataatgcattcaattaaacaataagatttgactatcctaaatatatatgcattcaacattggggcactccagttcataaaacaagtacttctaggtatatgaaaagaacttagccacacaatgatagtgaggacttcaacactccattggcagtgttagacacatcatcgaggcagaaaactaacaaattctggacttaaattggacacttgatgaattgggttaacaaacttctacagagtacttcacccattaatcacaaaataaattcttctcacctgcacatggaacatactccaagattaaccacatgctcagccataaggtgagtctcaataaatttaaaaaaattgaaatcatacaatttatacttttggaccacagtggaataaaaacaaaagtcaatactaaggagatgtctcaaaaccaaacaattacatggaaattaaacagcttgtttctggatgaatttgggggaaacaacaaaattaaggcagacataaaaaattctttgaaataaatgaaaacagagataaaacatccaaaaagttaacaacctaacatcactcctagaggaactagggaaatgagaaaaattaacccaaagttagaagaaaagaaataactaaaatcagagcaaaactgaatgaaattaagatccaaaaccacacaacttcccaagactaaatcaggaagaaactgaaaacttgaccagaccaacatggagctccaaaatggaattagtaattaagaaaccgtaccaaccaaaaaaagccctagaccagatggattcatagctgaattctaccagaggtacaaagaatagctggtacccattctactaaaactattccaaaaaattgaggaggaaggactcctccctaactcattctatgagtccagcatcattctgatactaaaaatctgggaaagatagaatgaaaaagaaaaatataggtcaatatctcagatgaacagacacaaaaatcctcaacaaaatactagcaagctgaatccagcagcacaccagaaagttaattaaccacaatcgagtaggccttattcctggcatgtaggtttggttcaacatatgcaaatcaatataagtgattcacctcataaacagaattaaaaacaaaaaccttatgattgtctcaatagtgcagaaaaatcttttgataaaatctaacatcctgtcataaaaaccctccacaaactaggcattgaaggaacatacctcaaaataataagagccatttatgacgaactcacaatcaacatcatacagaatgtgtagaatctggaagcattccccttaagaacatgaagacaaataggctccttctcaccactcctattaaatctagtagtggaaattctagtcagagcaatcaggcaaaagaaagaaataaaagacatccaaataggaaaagagtaagtcaaattatctcttttctctgattctgtacctagaaaaccctaaagactctgccctaagtttcctagaactgataagcaacttcagtaaagtttcaggatacaaaatcaacacacaaaaataagtagcacttctactcaccaattacgttcaaactaagagccaaataaagaatgcaatccatttacaatagacccccaaaaatacctaggcatacatctaaccaagatggtgaaagatctctataaggaagactaaaaatcactactgaaagaaatcgtagatgacacaaacaaatcggaaaacattccatgctcttggattggaagaatcaatgtcgttataatgaccatatcgcctgaaacaatctacagattcaacactattcctatcaaactaccaatataatttttcatggaattttgataaaaactactctatattcaatatggaaccaaaaatgagccaaaatagccaaggcaattctaagcaaaaagaacaaatttggaagcatcatattacccaacttaaaccatactgtaaggccactaaccaaaacagcatggtactggtacaaaaacagacatatagaccaaaagaacagacagattacctagaaataaagcaatacctctatagccagctgatttttgacaaagtcaacaaaaataagcaatagggaaaggattccctattcaataaattatgctgggataactggctatccatatgtggaagaatgaatctggacccctaccattcatcatatacaaaaattaactcaaggtgaattaaaaatgtaaatgtaagacctcaaactataaaaattctggaagaaagccaaagaaatacaattctgaacatcagccttggcaaagaatttatgattaagtccccaaaggcaattgcaacaacaagaaaagtcaagtgggacctaattaaactaaagagcttctgcacagcaaatgaaaccatcgcagagtaaacagacaacctacagaataggagaaaatattcataaactatgcatacaacacagttctaatatccagaatctttaaggaatttaaacaattcgacaggcaaaaaaaccccacaaataaccccattaaaaagtgggcaaaggacatgaacagacacttctcaaaagaaggcatataagcggccaataaacatactcaatatcactaatcatcagagaaatgcaaatcaaaaccacatgagatactgtctcacaccagttagaatggctattattaaaaagtcaaaaaataacagatattggcaaggttgtgcagaaaaggaaatgcttgtacactgctggtgggaatgtaaattagttcagccactgtggaaagcggtttggagatttctcagagaacttaaaacagaaatgctattcgacctggcaatctcattactgggtatatatccaaaggaaaataaactgttctaccaataataatagtaataataataacctatacactcttaaattcatcacagcacaattcacaatagcaaagacatggaatcagcctagatgcccatcaacagtggattggaaaattataacgtggtacatatacaccatggaatattacacagccatagaaaagaatgaaatcacgtcttttgcagcagtgtagatccaactggatgccattatcctaagaaaattaatgcaggaacagaaaaccaaatacttcatgttctcacttataagtgggagctaaatactggatacacataaacataatgatggcaacaatagacactagacaactagaaggggagagaggaaaggatgcaaggagtggaaaactactattgggtatatgctcactacctgagtgatgggatcatttgtacccaaaccttaacattgtgtaacatactaatataaacaatctgctcgtgtacacctgaatctaaaataaaagttgaaactgtaaaaacaacatcaaaaaattctgtcagaatgtcattggaattttgatagacattgcagtaaatctgtagattgctttggggaatatggacaatttattcatttatttattttaatgtatattatttttaattgacaaactagaattgtattacatttattgagtacaatgtaatgttttgacattttgtgtagtgatatatttgaaatttgctctctctattttgaactaagccatacataattattgactgtattcactctcctgtgcgatagatcttaaaacatatccctgctgtctagctaaaaattttaagtttttgattaacaaatccccaagtcctttgctgccctctccctctagcctctgttaactaccattatactgtctgcttctatgaattcagctatttttagattctataaataagtgagatcatgcattgtctttccatatctggcttatttcacttagtgtaatgtcctttaggttcatccatgttgtcacaaatgacgggatttccttattttataaggctgagtagtagtctattgtgtacgtatactacattttctttctccattgatagacacaggtttattccatatcttagatactgtaattaatgctgtaataaatatgggaatgtagatatccctttgatacaacgatttcaatgccttggatatattttcagaagtaagattgctgaatcatattttagttctatttttagttttttcaggaacatccatatcattttgtataatgtttattataatttacattcccaccaacagtgtacaagtgttcccttttctctgcattctcaccaacacttttcttttctttttttctttttttagatatataagccattctaacaggtgtgagttgttatcttactgtggttttaatttgcattttcctgataattagtgatgctgagttttttttttttcctaaacccgttggtcatccctaggtctttgtttgagaagtgtctgttaaagttctttccccatgttcaaattttttttcttgctactgagttgagttcattacatattttggatattaaccctttatcagatatatggtttgcaaattttttttccactctgtgggttgtctgttcactttgttaattggttctttggctgtgcagaaggtttttagtttaactaacaaaagcaatccaatttttctatttttgctttcgttgcctgagctttcagggtcatattcaaaaaattattgccccgagcaatgtcatggagctttccccctatgttttcttctaatagttttaaagtttcaggtattatgtttatgtctttaatccattttgagtttatttttgtgtatgctgcaaaataaaggtctaatttcacttttatgcatgataaccagttttcccagcactacttattgaagagactgtcctttacccattgtgtgttcttggtacctttgtcaaaagtcaatcgactgtgaacgcttaggtttattccctggctttctactaaattgttccatttgtctatgtgtctgtttttatgcaagcactgtgctgtttttactactgtagctttgtagtagatttcaaaaataggtcaggtgatatccccagctttgttatttttgttcaagattgccttgaactgtttgtggtcttttgtgctttcacgtgaatttaaagattatttttggcctggcgtggtggctcacacctgtaatcccagcactttgggaggccgagacgggcggatcacgaggtcaggcgatcgagaccatcgtggctaacacggtgaaaccccgtctctactaaacatacgaaaaaattagctgggcgtagtggcgggcgcctgtagtcccagctactcgggatgctgaggcaggagaatggcgtgaaacctggaggcggagcttgcagtgagccgagatcgcgccactgcactccagcctgggcgacagagcgagactccgtctcaaaaaaaaaaaaaaaaaaaaaagtttttttttctatttctgtgaaaatggcaatggaattttgatgtaagttgtattgcatctacagatcacttcgagtaatatgaacattttaacaatgttaactttttcaaaccatgaacatatttttatatgtgttttcttaaatttatttgattagtgttttaatagtctttagtatacacgtttttcacctccttagttaaatttacacctaagtattttattttctttttttgctgatgtaagtgggattgtttccttagttttctgcttggataactcattattagtgtatagaacactacttattttcatatgttgattttgtgtcctgcaactttactgaatttatcagttctaacaagtttttggtggactctttagaattttctttatatgagattatattgtcagcaaatagaaacactttcattaattccttttgtcttaggattccttttatttctttctcttgcctagttgctctggttaggacttccagaactatgttgtaaagaattgtgagagtgggcctccttcttttattcctaatcttagagaaaaagctttcaacttttcatgattaagtacgatgtttgctataggtttgtcagatatggcttttattgttttgaggtacatttcctttatacctattctattgagagtttttatcatgaaaggatattgagttttgtcatatgctttttctgcatctaatgagttgattacatggtttttattcttcattttattagtggaatgagtcacatatattcatttgtattttttgaaccatcctcgcagccctgggtaaatcccatttgatcagggcagatgattcgtttaacatgcggttgcatttggtttgctagcagtttggtaaggatttttgcgtttaggtttatcaaaggcattggcctgcaattttcttttctcggagtgtccttgtctggatttggtatcagagtaatgttggtcttgtaaaatgagtttgaaagtattccttcttcttcaatattttggaagagtttcagaaggattggtatacaatcttctttaagagattggtagaatttatttctaaagccacccagtcctgggcgtttctttgataggagactgttactgatttaatcccttatttattgctgatttaatccctttactcactattggtctgttaaggttttctattcatgagtcagttttgttaggttctatgtgtttaggaatttataaatttcttctagatatccaattatctggcctacagttgttataatcatttgtatttctgtggcatcagttataatgtgtccactttcatttctgatttttatttctttgagccttctttctttttttcttagttagtctagctaaggtttgttgattttgtttatctttaaaaaaataattatttgtttcattaattttttctactgttttcctaggctctattttatttatttctgcttggatctttgtcattcctttccttctcttaactttgggcttagtttgttcttctttttctagttccttgagatgtaacattacattgtttatttgagatcttttgtctttttgatatagacatttattgttattattttccctcttagcactgcttttgctgcatcccacaaaatttgttttgttgtgttttcatttttgtttatctcaaggcattttttgattttctttttttatttcttctgtgacccattggtttttaagagcatcttgcttgattttcacatattttaaaattttataaggtttctcctgttacagatttctagtttgatgtcattggttggttggtatagttttaatcttccgagatttgttaagaattgttttgtggcctaacatacagtctattttagagaatattctatgtgctcctgagaagaaagtatattctgttgctgtttggtggaatgttttgtatgtgtctgttagttctctttggtctgaggtgtaattcaagcctagtgttcccttattaactttctgcttagatgagctgtctattgttgaaagtagagtattgagatttcctgttgttatggtattgcagtctatcattcccttcagaaaatttaataattgcattggtatatatgtgctcttatgttgggtgcatatatatttacaattatattcttttgatggcttagcactttctattgccgtaaaatgacctactctgtcttttttatagtttttgacttaaagtatattttatatgctataagtatagctaccatgctctctttgtttccatttttatgaagtatcttttcccatcccttcatgttcagtctatgtatgtccttagaaggaaagtgagtctcttgtaggcagcatatggtttgatctttaaaaaaatctattgagctcctctgtcttttgattagataacttaatcctgttacagtcaagacaatttttgatagtttaaacttactaccattattttcttaattgttttctggttgttttcttgatcttttgtttctttcttaatttcttgttctcttcctttgtggcttatagttttctgtggtggtcttctttgatttttttttatattttgttctacaggattttgctttatggctaccatggggcttatataaaacatcctaaatttgaaacaggctattttaagctaataactttaattacaaacagaactgcacattaattccctccttccccttgtatacttttgatatttacctagttttataatttatatctcttaattatttattgtagctacagttatttttaatagttctttttttaatcctcataggacagataaaattgttttatgcttcacccttacagttttagaatattctgaatatgattacatagtcatattacttataccattgagatatttacttttgtgtttttgttattaattagcagattttcattttagcttgaagaactccctttagcaattcctatggagcaggcctagtgatgatgaattcccttagcttttgtttgtctgagaaagtttttatttctgcctaatttctgaagagcagactttccaggtaatgtatccttggttagcacttttttcttcagaattttgaatatctcattctactttctcatggcctgcagaatttctgccaggaaagctgttaacagctgtattgggactgctttgaatgtgatgtttcttatctcttggtgttttttttttgtcttgcatttttgataattttattctagaattttttgataattttattctagaattaatgtttgggttgaatttacttggagacttatgagcttcctatacctgaatgctgtcatctttcttcagattttgaaaatttttagtcattattaccttaaatgtgctttctgggcctttgtctctctcttcttcttcttcagaaactcctattatgtggaggttaattctcttaatagtgtcccataatttctgtaggtcttttccattcttttttctttttactcctctaactggataatttcaaatatcctatcttcaagttattctttcttccacttgatcaagtctgctgttgaagctttctattgaattttatagttctgttattacatactttatctctaggatttctatttttattgtttctatttatttggcaatctcctcattttgttttataaattgttttccacatttaatttagttttttatctgtatttacttgtagtcccctataagtaatacgactatgtatcatattcagaatattctaaagctgtaacagtgaagtataaaaaagctttatctttcctgtgaagattaaaaagacacaactattaaaaataactgtaggtacaataaattattaacggatacattttacaaaactaggtgaattttttttttttttttttgagatagagtcttgctccgtcacccaggctggagtgcagtggaatgatctcggctcactgcaacctctgtctcccaggctcaagcaattctcctgcctcaacctcccaaatagctgggactacaggtgcatgctgccacacacgactaattttttgttttttagtagagacggggtttcaccgcgtttaagataattgttctgaattcttcatcagtcattttataaatcttcacttcttcaggatcccttattggagatttattaatttccttatgatgatgatgtattttttcagatttttcataatccttgtgtccttgcattggtgcccaaccatttgaggaaatggccaactattccgcctttgtttgtgttatttggccatggtataccttcactatttgatcaaacctggaattctgattaagcaagttggtggtgaccttgaacgggaagaccttgctgtcatgctctctagctgggctgaactgttaactgtactggttgagtagaatttctggctctgttccatggtctggtgagagaactggctggactctgtaataagacagagctgctggctgaaattgcctctgattgagcagtattgttggttgtcttccttagatggccagtactacagttttgaatatgtagttgggcaaggccatgttttaggtgtcaaggctgaacaaagactctgagattgctacctaaccatgcagggtgacaggaccagaggctgtgctccacagatacacatgggcatgggttcagctctaatcctgggatgacctaaggcagagcaccatggcttgatatattagccacttggatgctgggcctgggtggaacagatgctccttctacagttaattgccaccatgcccctgttttctggccttaggaagcgttaaggagcacaaagggcagggcttgactgggtgaaagcttggcagctgggaatggttggggccagatgttctctttgcaggtaattgccattctacccttatctcctggcctggggaagtttcaaggggagcactggggctgagtgtggaagctgagcagagattcaaacctggcagactaatcaactgtgcttcttgttgagcattgcaagcctctctggtggtgtgcctctgctggccagaatgcagagcaactatcaagacccctgaactggtcactgtgagtctcaccctgttctgagtttctaaataaacattgctaatgtttcctgtgggataagacaagagagtttcttctgcgaaggattccaaaatggtgggaaagctgaatgttcattctcaactctctcttccctctgtaaaagccatgggttctgggaatcctcttatgtgtgatgtgctggcttgagggagggacagtgtggtcaaagtaaaacctcctcttgctctacgtgtgtggtttttctcagtactgtggtccaaggggatgtctgtgcctcacttcaagttctgagatattcacaagggtatccttgtctgctgttggttgctagttggatttctgtggtgggactactggagtcagagaattcctattctattatatttctaacatctcccctagtatgaacattttagcaacattcacttttccagtctgtgaacatgtaatatctttctatttgtgtcttcattttctttcctcaatgttttatagtttttagtatacagatctttcacttctttggtaaaatttattcctaagtattttttggatgatattataaatgggatttttaacttctttttttggatagttgttatggtatgtgtaagtgctactgatttctgtacgttgattttgtattaaagtcttaaacataagacctgaaattttaaaactactggagtaaaacacagggggaaaacttcttgacattagacctgggcaaatattatttttgaattttgaccctaaaagtacaggcaacaaaataaaaaatagacaaatgtggttgcatcaaagtaaaaagcttctgcaaaataaagcaaacagttaatggagtgaagagacaacatacagtatgtgataaaatatctgtgaactacacatctgataaggagttaatattcaaaatattttagaaactcaaacaactcagtagcaagaaaacacataaaccaatcaaaaaagtgggcacagggagtttcccaaaagaagccatacaaatggcctacagtatatataaaaatgtgctcaacatcgctaataatcagggaaatgcaagttaaaaacacaatatcacctcacatctgctagaatggctattatcaaaagacaagaaataacaagtattggcaaagatttggagaaaagggaacctttttacagtattagtgggaaagtaaagtagtatggccattgtggaaaacagtgtgaagtttccttaaaaaattaaaaatgaaactactatgtgattcaacaatcccactactgggtatatagctaaaggaaatgaaatcagtattttgaagagatatctgcactcccaaatttattgcagcattgtttactacagtcaagatatagaatcaacctaagtgtcctttagtgggtaaatggattaaaaaacatgttatataagtgtaatggaatacaactcagccttatataaaaagggaagtttctaatttgtgacaacatgtataaacctgaaagatattatgctaagtaaaataagccagatatagaaagacaaatattcgtgatctcacttttatgtggaatcctaaaaagtcgagtgcgtggaagtagaaatgatcattatcaggggttgggttggggagtggggaagaactggggagatgttggtcaaaggatacaaaatttcaataagaccggagtaataaattcaggagatttattgtacagcatgatgactataacaatgtattgtatttttgaaaatttctaaaagagtagactttgagtggtcttattacaaaaaatggtaagtgtgtccagctgtcattcctggagaacacctgaaaaccatcaccctttgggaccatcagtgcaatagaggactgacttacaaaggctgtggtcttaggcttgaagtctttttaaacacttctgtgatagtgcttattctgtcagatcaaatatatttacttttctgagtgatagtccatttaggctgtaaggtgctcaatggaagaaatatgtccgatacatctccatactactactgttgaaagaagtaaaacgaacagagcttggaatgaacaagcagaggtgggcaggaggtacagggtggaccagagtgggaagtacttctgcagtcacgaggacatcctgcttccatcttattaaatctttaggcatgtgcccaggaagacacaggggtcatcttattacacctttaggcacatgctgaggcagcaggcaactgggaagtgtctggtgctgtcacctccctggttgtgaaaacagcagcatactcaggttgtgcatcatcgtgtacactgcacgggataaaagggctcctaccctgggcttctcatccacagcatccttaggagcagccttcttctcctacctcctctgcatctggtgagtggccagcaggggacagatcctcagctgggagtgtttgggaaagagaggcccagaactgaaatggaaccatcagaaagaagcccacagtgggcagcagtgggggaggtgatggagaataaggagcctctaaagcacatgtcagggacccgtgagctgcaaaacccgcaggaccttaggattccttcacattcttgtttggagcatgttgtcaggaatgcacatagatccattttatatttttaaggttgctttatccaaatgcatgtgtagggttccctctactacattcccatttctctcctacagatcttggcttagaaagtggcttcatcaagggggtcagtgtgtgacaaacccaaaaata

SEQ ID NO: 276 - DNA, 26997 bp, Homo sapiens
tttcaaacaaacatttcatggttggaataaccacctattccttgcctcactaaactcttaccttgggtgtggaagcaagcagatattagatgtcctttttgtatccactaagacaatgatatccaatgtcaaaagtttgcccatgatgggtgccttcactgggtttagctactctttaccagcatctgtcaagtgccccagagtgggaatccaattgaatatagagccacctttgtctaaatctgctgccaagcaaggaagccagaagatgcctccaatgggcccctggaacataagctccctgagaggggactttgtcttgtttcaaactgatccaagtacctagaccagtgccaaataagtatgtagtgaatgaataaatttttgaatgaatgaggcttggcctagaagtcccctgatgaggactgaaaagtctgtcttcacacttactgagacctcacttgtaggaatcagcttccagtggcgggtcaccactgccataacttctggctcccatgaactgtactaatgtctcaacccaaactttcttagttgattctggtgccacctttctacatcttggggtaattcactgacagcaggagttctggtggtactttggagcacagatctgactccacaggcacagctaggtctctgtgcccaggtctagggatccttttttttttttttcatatttcttaaaacattttagaggaattcagggtaccatggtggtcaggagcatgtggtcagtgaaactgtctgggtttgcacggcagcttctgggagaccttgggcacccattctacattgattcccctctgtaaaatgggagaaggctagtatctaactcaaaggactgcagtgaggattaagttatttactgtatgtcaagccactggtacattatgagtcctatataaattatagatcctatgaatacatatccaatttgcaactcctgaaatgatctcattttttcccctttccctaagttcctctcagtatatgcccttgcaaacacctccatttctctctttgcacctgtcacctaattagctttcaaggatcccttcctaccccgtcaacacccagatcttccctatagaaataatatgaatgttttctctgcagccgtgtgtccttctgcaacctctttccagtcctaacacataaactcctcacggtctccctatgaatggagataagtgacatttctcattcttcttgtcctgtgaggcactcagcctgggagataagaaggggaagagcaatggagcagctttgggaggggcaaaatagaaatgtaggtggagaagagaagctttatttttcacagagtgagacataagtgctgctaagcactgaacagaacatgggtgtggagacaaccatgagggacacccagggagaccgctggagatcactgacaaccctcttcaggatgaactcaggagctcagaccatgggcaggaggttaggagtgggtacatcagactgaggttaatcctgggcactttggtctctggttcctttaaaattgctcatctcaatgtactgccaaggtcagcagtaattctctagcaatggctggagcccctggcaggctcactcacagcagtagaggctgtggtgcctgtgccagtagaaaagatggggcctttgataggtcaagcagcagtgccccactaaagttaaagtgacccctgaactggggctgcagggaaaggctggaggtgggtatgaggcttagtactggggtgtgcactttgaaggctttgggggttatcactgctgctggttttgctggagggcatctcagaagacatcaatagaatcagatgtgcttgtaatgcacaaacctctgtcaatatctcttctgtgatgggtgtcatagaccccatgctctcctactgaactaagaaatacacggaagaaatgaaaagttacttggagttagtttaccttggaaaaatgcgtttttctctggtctcctactagaaaaggatgctgagtcttttctaactgggcccctcaggtatcttatctccatgtaatcacagaggagaataagcctgtttgggtaaaccttccttgatgatgtctggtgagatcagtgcatctcgcagaacaaatgtaggaagaagatgagggtgtgctgaaaacccattaccttcacagtcacaggacacctgaaacatcctgagagggtgcccattaaccccacactcttcctggtgcctccatcccagaccctctgcttccttctcccctgatggaagcctgggcttgtcttcctaggtcttccagctcaggtcctgtctccagctagacatccatctgatttcatagaagccagagaatgctgattttgagaagtcagtggactggggagcccaggacaggagctcctagcatgtgaggggcagcatgagtgggctgctgggggagttgacagcactaagtaccccagcccagcttcaggacttatccaccttccctggaacaggatggcatgtttgaccacaaagagcctggtcctcacttgtgcatcttccacccaggcctacatgtgtccttaaaagaggctgtgccctgtgctttgtggtgaaaggtagagttcaatatgacatgtcacctgacctatagaaattaattgtctaattgcacagacaaacaagtaaatagggagcctgcttccatgagaaaattgctataatgtaagtcactatgcacaaagtttgcaggtctttgtccatatacttctttctagcatgttcccttaggaaaaccaaacacccagatgtggtgttggggtggtgacttgctgttggggcggtgactgagctaaggacgctggacattcagtatgggctgtgtgtaaaacagatggaagcctaaagtcaggggaggtgagggtccctgaaagagcccccgggcaggagaggaggggagtcaaatgagtacccgattgaagggcaaatgtagagaaggaaagtacaatagttgcagtaataagagtcacaactgacgcattataaaaaagcatgaccttccatcaaaatccaaggaatgcgtgctctttatttgaagacgatgaaaacactgagggaggagtcgttcatctgcttggactcggtaaggaagttgtgcaaatgtgcatgataatggatggccttgatgaagatggctttgctgtacgtgttgctgcttatgaggttgatggtagtgctgggtgcatctcttgtaatgaagctgacctgatggtgtctatgtttgggtatgccgaattggtgcaaactgaatgctatttccttgttaatttcattttaattttaaatgaatttatcattcaattaatctctaatattaaaagaccttttgctagatatttttcaagataaatcacagtcaggtctataaccaaactttagccatattaaaattataattttcaaagaaaattaaattatgttcattatcagtgggtgtaatttttctcttactctgcctaagagtttgcccctttaagtacatagtgatgcctgtaggagcataaatgcaccgggctgtaaggaggacagtggctctgtgtggatgggtagagggtgggtgcagattttgatatcctcagcagccttttcctgcctccagcccatggtacctgcctctggttgaaaggtattttcagaatcatttccagaactactcctgagtggccgtttttctcatattgtttagggtttcttcagtagaccctggcctgcaaaaaggcacttaagaaaaatggaccaagtactttctcatggtacctagattgtgaagctgaacaaagctgggtggccacttttgcttcttaggtgtagaatctctagtatttgggatacaacaacagaggagtaagttctaaagtttcaaaacaccccagaactgtagtgggggccctccttctgtctcatggaatgcagcagatgtgtgcatatgggcctctccacagcccctcccccgatgcctggcttgggaggctccatacttgtcctggtgaggatgcccaccaaactttcttcccctccacgaggaactcccactttttggcccctctgtttgttatcagagcaggagctctgtaggttcaaggctgagcaggtgtcctgggatgacagaggcttggctggaggaccactgccctgccacttacccagagcatgacatcagctctctgagggtaatctctaccaggagtaccacccttagatctctggctttctaaggttctgtgaggtcaggtgacaagagaacctggcctggctggatatatctggataatttcatgacttagtagtgccaatgggaatgatgggcacaggtggtatagtggctcaggtttggctctttggagtgcattttaatcaggtcatataaaatacacgtaaatgactatctaaataacaaaaagatctttttcattccctgcagaacacagcttcctttcagtttaggaccttcccatccccaaaccattagcatgaccatggcaagcagctgagacaatctgggttctcaatgttatccttgtgtccctagtggagacacaggtaccacagagagatgtgaagccctccatgtggtggttgggagtaaaaggggaatggaagagagccttactaatggaaaagatccaggaatcccccaaactgtccaaatatctgttctttaaatcttctgtaggcctaccatctcttatttttctttttgtccttcctcccctcatcccttctcttcttccttcctgccctcctgcccttctctttcccttcctgccccctccctctctattccttccccattccctttccctttccctacctttccctccttctgtcattctttccttctttactttggaatatgttgagctgaacaactgtaatctctattactacgccctctatatcttcttgggcagatgctaagagtttttttgtgaggaaagtcacaggactcttgaaattcctggggcccagccttcctgtaggcctgtcactttaattttttctttcattcagtcatccatttattcaattattcaagtgagatgtgttgtgctgatatggcacaccaggcattttgctatacacaggagagttataaatgaataagatttgttctctgttcttgagtagctcacagtgcagtggggcagacagacaaataacaaaataagcatgatccaatgtggcaagtacaggaatgcaggtgtgtggaatgtccttgggctcaagttcagaccctttgggtttcaaaccccttttacttggagtgactctgtgggggaaaatgtgtctagatgttgccacatgctatcatttgaggatgagatcactggcctttgacaatagtatctgtgcaagtagcaggagcagaggtataaatccttgatctgtctgtgggcagccagccaagatggtgataccaagaggagctaatggaacccagctcatggaacctcaccaggaggaagagataatgctgttgctaaggagaagagagctgagggggaccctgagggatctaagacaaagtggagggggcaggataatgggcttgttcagagcattcattttggactcagacattcctgagtttgaatcctgcttccccaggtagcagctggtatcaaggtgggaagctataaagtgataagaggcacaatggaccaaagatgtgaggggcaaaatcagagaaagagacaggaagtctatagaggctgtgaggacatggtttacaaattaaagtacatctgagggccattgtatcagtatcttagtgactgtggtatttactctaagagctccagagtagtttcagggagggagtgatccaccttagttggggtggctaagggaaattagctgagctgtgaataatacttcatggatgtagtgatgatgaggccaacagtggggaagcttgtgaacactgaatgggcagtgattgaacaggatttagcaaattgcaattacataagctatgtagtattttttccattgcattttatataacattagagatgcattgcctctgaaacaccacctttaaaaatgggacaaatcttttaaatcaaaaacacgaattaaaatgatcacaaaatgttactgtcttttataaacgttgatgaaaattttgtgtctggttatcctgttacagggaggcgtataagtgatgaaatctccattagatgatgaaatagttaatatttgtgggatgaaaagtgaccctgtgagaagaggtttattcacagggctgtggagagagggagggagatggggaagggcatgaggagagaggcctgcttgtgcaataactttgtccccttggtagtcatgatttatcctttcttctttcttggctgttgtcttttgatgtggaagctagaaaacacttgatgccctttccttttgtcaccaccaaagccactgtctcagagcctcaatattttgcctaggctgagtgtcttctctgggtttattaaataaacaccagtgtccactcacctccagaggctgagaggccaactgaggagaaggccactgtgattcactctgcgatgcatgcaaaatcgggaactgtctcctttggaccagttttgaatgtgaggtcccaaaagacagaaatttgtctctctgattccttattgtgtccctagtgcctacaatcaagcacataatcaatgctcaataaaaatgtgtcaagtgaataaatgggtccagggctcaggacttggtattgcccagatgcagtttgggactttgtttttctctgctgctggaaactcccttattgggctccatttttgagaggtccttttatacttctttatagattcccaggatctcattgatttgccagcaatgttgactctgctccattttctctccactcagattcgatccaaccatagccagaaccccgtcattcttcagtgtagtggaatgaggtgttctgggcctccaaccttgttctgcagcccctgacaggaggcaggctctaattctccagttttgtccagcctgtgtcatgctgcttccaggtctgcacagagatgctgggtctgcatgtgggtatcactcacattccaagtgtggagctttgcaggctgtatcagccatggcacactcttccctgggggcaggcctttcacccccttcactgtccctgggtgagagctctctagtgatttcaaaccgaacttaaaccaatggcccaaagctgtgcctcctgcttcaatttcaacaaatttctctctttttttaaatacctattggtgcgtatctgaatatctgatattaaacttctctcaggttctttttttttcttatttttggaggtggagtctcactctgtcacccaggctggagtgtagtggcacaatcagctcactgcaacctctgactcctggttcaagcaattctgcctcagcctcctgagtagctgggattacaggtgtccaccgccacgcccagctaattttttgtatttttagcagagatggggtttcaccatgttgtccaggctggttttgaactcctgacctcaagtgacccacctgccttggcctcccaaaatgctgggattacaggtgtgagtcaccatgctgggcctcagggtctttttgatccctaaattttaagaattaatttataggatttgacaaaatccttttttagttcaatggacttataaggttatccatctttatttttaatgccccccctccacctgctctacttagccctcacatcaacttctcttagtatttgtaatttgactgtagctctacgtgacacttctctggttttctggtagtcaaagtgagatgttactcttagttcacataaaaaaacattccttcaaccccaggagcatctcagtctcacaatttaggccaaaacatgtgactccattgaagttgtaacttccatgtgttgatgtcaaggtcgtgtagttacaaaattaataatttgttgcttctttggtatatctatttataattccaggaacacttctcattttctgcctttttctttttcctaaaattctcattttgcacattccaataatctcattgagtaaactcccagccacatctctgctccattatctcattaatttaagcacctctctcagctttcatctctctccctggattttcagtcactgagttatacttcttcccaaggcttacatctcttccctccatcttttgattctgcttctcttctgcctattttctgcttttttgccttttgatttccggtttcttagttagcactccagaaacagctcatcaaaacaaactagtggtcttctgtcatacactggaaattccccaattgtattaatgtcctctcagattttacaggaaaagtcaatttttgcactgataccctctttgagtttgaggttgagtttcagggcctcaaaccagcacaacctgtgtcgttctctccctcccactacaacataaaactctccccttcccttccatcagtggagcggggtcggatccactatgttttcctggtgcagagataaggtttggctcctgagctgggttgtactgaccaaagagctgaggagagagactgtgaaatgcccagtgggacgctggtggtaatgaggacaaggaactttatcttttttacgaggttgggcacaagcactgccaatccttggcaggtacaggggtagggggacatatgacatcctgtacataaaacaagaagtgccttctggggagagctcagatcccccacaggaaaacctccagctcagcctgtgaaagtcagaagagggtatatgggaaggcatgcgtcagatggggctgttcttggcctcttgggattcttgtttcctccaaagatcgcttgtctcagcatcaggatctggatcagcagcagcccccagaaccgtggcagcagccagagcccccgccttgctgaccactgcccctgtcacaggagttggacctctggcgccggcatcggtggtggcgcctgtggtggttcaggaagcagccgccctcggagctagggccacagcccccagagcttggggcacagccagaggaagctggaggcagacactgtactgggttctttgggggacacttgggtgaggggcacttgggtgggggttggcactgcttctggttctgctggcaggacatcttggcaggagttgagatgtcctggagaaaacgaagccacttcttagttcaaaatctacagtccaacgtctctaagaccagctgcctcctgaggcaagagctgcaagagggtgagggaagctgatgtggagctggtgggatatgccagatacttctcacattgctctccacccgggacagattgctgtgagtctaagtgggcacgtgtgtttctgtttctccaaagaacccctagggaatgcacccttttgggaaaaagaattctgtagaatggatgttacaggaaatgtgcctgcctgagtagaaagaggatgggagggaattgtgagctctgtggcctttgcaggtcatggaattgctgtcagttcctgcagggtctccctcctgcccccttcccccattgctgccctctcacagtcctgtatctgggtctttgtttcaaacctctctgtttccatctcttctgctatggccttagctttctgttctaacatcccatatcaagccctgtcccctgctgaatacttaccaggtgcagagaggcaggagaaggctgttcctgaggagactgtggaggagcccagggcaggagtgcttttatcctgtgcagggtgtgtgatgcacaggctgggcatgctgctgctttcacaaccaggggaggtgacagccaggcacacccttgagactatccattcatcaccttcctgtgtactcaccaagatgcctgacaagagggaaccaggaaggtctgacgcctgtttaccttcacctcattcaggcctgctgggggttgcaatcctaccttccttgaagcaattgtttttatcaccactcattagtagtcactccttattccacattgcccctctggcaactagtaatcaattttttgcctgtatggacttgcctattctggacacttcatataaatagaatcatataatatatggcattttgcattagcttctttcacttaatatattgtttaagatttatccatgctgtagcatgtgtcagaactccattcttctttatggttgagtaatatttcactttatgaatttagcacgttttatttaaccattcatcaagtgatggacatttgagttagctccaatttttggttattgtgaataatgcagctacaaacttaatctttattatttccttcctcctgctttatgtttagtttcttctttttttcagtgttttaaggcagaaggttaggtaattgatttgagatttttcttcttccttaatgtaggcatttgcagccatgtatttccctgtaagcatttcctttgctgtatcccataatttttggtatgttgtatttttattttcattcatctcaaagtattttctaattctccttgtgatttctttctgaactcattggttgcttaagacatttctgaattttccagttttccttctgttattgatttctagtttcattctcctgtggttacggatgatactttgtatgatttcagtgttttaaaatttaatgatacttcttttatgacccaacaaatggtctaccctgcagaatgttccatgtgcaattgagaaaaatgtgtattctgctattgtggttggagtgttcaacaagatgtctgttagatttaattggtttatagtgttgttaaagtcttcagtttgttgattttcttcctagttgttcttccattaatgaaagtggagtatgaaagcttcaagtattattgttaaattgtttatgagttgtctgtttctcccttcaattttgttagtctttgttacatgtaatatgggactccattgttaggtgcatatatatgtataataattatttctttaatagatatggatccttttgtcattataaaatgtcctctttgtctctgccattaatttcgtcttaaagtctatttcgtccagtattgtatagccactccagatctcttgattaccattgcatggtgtatgtttttctaccttttactttgaatctattttgtctttgagcctaaaatgtgtgtcttatagatagcatatagttagttcatgctattttatccattttgccagtcttagccttttgattggggtatttaatctattcacaattaatgtaattactattaaggtagaatttatgtctaccatttactatttatttcctatatatttcataactttctttgcccctctttttcttcactatggctttgttttttattgaacaggcattttctagtatacccttttaatttcaatgttatatattttagtatattttttgagttattttcttagtggtttccttgggagttcttattaacatcttaacttacagtgattataactcagatcaataccaacttaattttgatagcacgcaaagctttgctcctgtgtaggtttgttccctcccccttctgtatactgttattgtcatataaatcatatctttacattagaaggccatcaatgcagttctataagtatttctttatgcagttgtctttcagatcaaattggagaaaaaagacttaaaagcacaaaatgcatttatactgtcttttatatttaccatgtagttaactttacaaatgctcttcgtttcttcataaaaatttcaaatactctctagtgttatttcatttcagactgaattaatccttttagtattttttgtagagtagggtttctggaaacaaattttctcaatttttgtttatctgggaatgtcttaatttttggagaatagttttgctggatatagaactcttggtttactttttttttctttagcactttgaatgtgttatccaactggcttctgtcctccatggtttctgatgagaaaccagctgttaatgttattattaattttttttgtatatgatgggtcttttctcttttgctgttttaaaaattctctctttgtcttttgacatttgtactatggtgtgtttaggtgtggagaggtttgactataccctgctaggagtttgttgatcttcttagatgtgtagattaatatttttcatcaaatttgataagtaattaactgttattcctttgaatattcttcctgtctttttatttctctcatctcctcctgggattcttattataaacatgttggtgggcttgatggttactcacaggcctctgaaggctctgttaatttttattcaatcttatttctttctgttcctcgggttggataatcacaattgacctatcttcaagttcactgatttgttcttctagttcaaacctgctgttgagcccttctagtcaattttaaatttcagttattatatttgtcaagcctcaaatttctatttggttgttttaagaaattctttttaattctttgttgttattctctatttggcaagacaacattcttatgttttcttttaattcttaagacgtagtttattttagtactttaagcacatttaaaatagttgatttttatctttgtctagtaaaaccaatgtttaaacttcttcagggacagtctctcttgactacctccctggactttgccccttgtgtaggtcatactttcttgtttatttgtagctttctttcttttttggttaataattggacatttaaaatgatataaaatcctggaaatcaaatttcccaaccctctctggggtttgttgctgtttgttttcactgtccatttgcttcatgactttcctgaaccaattttgtaaaatctgtattctttattgtgtgtagtcatttaactctgtactcagttagcttagtagacagagatttccttaaatgccttgagttaatgtctttcaacctttgctgaggacctctgtgtgtatgttggggcatgttttcaagacttcagaagacagtttacaaatctgtcttaggtttcatttcctgcttggatggaacttcaagatcagtcaaagttgagatattagggtcttcccaggtcttttctgtacatgcacacaccctgtaagtccacatagtctcctagatttccagaaatgtgtcatagatttttaaaactctctatgagaatctcattcctcagattttccatctaagtttttggtcaacttctgatttgcccaactattatcaccatcacaggcagctgtgatgctaaacattttttactgattgtttttggcaaacaccctggggtaaaagctgttttcagtgagagagttctgagtcaactggaatgaaaacaagcttggctagttgggatttctaggggaaatgggaatgggatcttcattatgtgccatatagtcagataatgacatttctctagggatggggtttttggatagtttcagatatgttctgttacctccatgtgctactagcattttagatttcaagactattatggcactgggaacagggagatgataatagggcaagttaaaatgtcacaaagctcactgctcttacccatattcaactgcttttcttaagtgaacactctaatatttttgcaagcctttggtaaatctccagagttttgcaaaagttgattttcacaatttttcattttcaaggtgtttttaatggaagagcagatttttggagatccttgctcaatcattcccaaccttgtcttcttaagtgaaaacatgagtccctagtttttcatctgggtcacaaacttcacatccaataagcattattattttgagatatacagctcttctcatcaccacagagatgcttccatataatatccaggtcatatatgagaaagtaagattaagcttttcctgttttattgagatttgacaaaaataactgccaacttgtaaacaataggcacaaataactctccaccttataaagaggttggaaggagccctgagatgctatcactcttctcttgttatagtaatgagaagttttcaaaactggatagaatgctgtggattttccccttacatttcacatggggaagcaacaggttattactcttaccctccactagaggaaaagtcatagaaatttcaaggggacaaattgtagaacttatcaatgcctaaaaaacagaaagacttggccagtagcggtggctcatgcttgtaatctcaacactttgggaggtgaaggtgggtggatcacttgaggtcaggagttcaagaccagccttgccaacgtggtgaaaccccatctatactaaaaatacaaaaatagctgggtgtgttggctggtgcctgtaatcccaactacccaggaggctgaggcaggagaatcgcttgaaccagggagacggagtttgcagtgagctgagattgtgccactgcactccagcctgggcggcagagcaagattccatctcaaaacaaaacaaaacaaaacaataaaacacacacacacacacacacacacacgcaaaacccaggaagactaaaatttcaggtctcagtgtcatcattggacttgctgaacagttctctggctattctggagagtgaaaaataattggaaagggaaaatggaaaggagaatggggaaaagagaagcagccagtcccttactgcttgacatggccagagttcatgagtttccctgagccagtggacagtttggagggcagctaggcatagctgtactgccacagtcctgctgggaatgtggctatcaaggcaagaggcctgtaccaatggggctaagagtgcaggggagtgtcaaaagaggccaaatttttcacatcaggtcactgtgctaaaggttccttaaagaaatcagtcatttatctggtaagagagccctcatgggtcagcacagagaggatgcagccactgagagacactagcagtaccagccaaatatgagatatttgctttgtccccccttttctcattccggcctcaaaacagtgcagaataaagggaacccgcaggggagaggaggaggtggacaataaatgatggaactaaccatgtctcttttccacacactagatgcctgttttccacacagtcctttaggagacagttgggctgtgctgggttggagagggaggagttaatattcttattctgagttatatccaactggacaggataggatgcttcctgaatacctgaaaaatgattagaaaggcctgaaacacacttgagatattatcaaagtagagtcagtataacatagtagaagacagagactagaggaaaaataagtcactatttgtatctgacactgagttcagactacttaataaacttcagaggcccttggaagattttcctgccaaggatctctcttggttcttcctctctttccaatatcagtcaataaataaatcaatactcaatttcataaattgcataatattttttaaactgcatttaggaaaacattccttcttggagctaattatcactgtaaaatcagggctttgtggtgaaaaatgtgaaagacttcagatgtcaacaatgaaaagttttgtctccaaactccatgtcaccctcaaaaccttcagtttctgtgagctatcttgggtggtctgtgacatgatctttctttactcttgagctgggctccaattttcagtacaggtcatggtgggcctggagtgctgaggaatgggtcagacctccaatcatccagggggctttgagttgctaagagtggtgtagggaaggcagataaagttgaagaaagttttgttatttcagaaagtcacatatagaaagaggagatgggggtcggggaggtagggagaagatggatgccaggagatcagggagggtggaatttctggagagaagagaatcctctacctcagaagttctcagctttggctgcacattggcatcatcttggagggttttttaaaaatacaaaactctgagtttcatccctcaagacgctggttggcttgggctaggcatcagggttttagtatctcccaggtgattctgatgcacagtcaggtttgagaggatcagatcacatgaggtggaagagaaagaattggaggttggagaatgagatcacctgtgggcttacgtgcatacgtacctattgtccacaaaacaaacaaaaaattctttggctacagtactagtctctggctggtcaggaactggctgatttctctagtctcaacttctactatcctcttctacttctttacctgtctttgtcacaccaaggggtctgaggcttctccctgggcctgagctggggggcaccttagtgactgaagcttggtgctcagggagtgtctgtctgaacaccttgaggaaagaggcagatgtctcaggaagttctagttcatagactctctggacaggatcttgttaccaggttctatgttgcttgcttataggctgcagggtcctggtagtaggcgggggggcgggaggtgtgggggaggaaagagtaagtttttctaagagaaggatctgggatgccccaagactgtccgggtacctatttcttaagtttgtttttggtgtgttttcttctctttctcccatcctcttttgctctccccctctctttacattccttctttactttcttctattctctaaaaaatgaacagatattacacagtgggcatggtgatagatgtgcaatccattggatggtggacacacctaattataaataaatgagatgtggttctggttgagtagctcaccttgtagcagggcagacagacaggtgatcaaatgactatgacccaagatgatgaaagctacataaaacatgtgttgagtcctgaggcttatgcaagagcttttggctatcagtctcctgtctcctcagtgtgcccagaggttgtcatttggtatcacttgagagtagttgaggtgaggtcagcagcctataggagctgatgatgggcatggagcaggaacaaagggataaggagtctgacctccccttgcagtttatggtcagagagacacagagaaactcatgaaacctaggaggcagaggtgtccctgcagagagaagggggatggacaaaattcctgtctgaggacagaatgtggtggatagaagcggccagaataataggttcattaagaacataggttggggagtcagatatttcaggctttgttttcttatttcttcaggtgatagttgtcataaggtaaaggtgtttgaagagagaaaaaactacaatggaatgaaagcacagtggaccacggatgttagagctgcaaccagagatggagataagaaactaacctacatctgatgaacgatgtgtcagtaagccactcactttgtaagtttctgagttgcagacatgggtcagagaagaaggtgattcacccaggctgggatattcagggagaatttatctgaaaggtaattataattaattgaaggtgaataattatagatacattttgtagtgttattatgtatacctgatgtaatgcaattgatgtgtgactaatgcctgtaaaaactgcatttgaatcagctctgtagaattttcctattgcattttattataacaataaagacgcattttcttctgaaatataagcatactcaagaataagacaaatcttttatatcacacaggtaattaacaatatgtatttttttcagacaaatacaccagtggttcagaatagaaagccaaaaaataaggccacacacctacaaccatctggtattcaacaaagctgacaaaaacaagcaatggagaaaagactcctagtcaatacatggtgctaggataactggtcagccatatgcagaagattgaaactagactccttccttacaccatatacaaaaatcaacttaagatggatcaaagacttaaatgtaaaacccaaaattataaaaaccctggaagacgactgaggcaataccattccagacatagaaatggacaaagattttatgacaaagacaccaaaatcaattgcaaaaatgacaaatgggatctaattaaactaaagagcttctgcacagcaaaataaactatcaatacagtaaacagacaacctacaggatgggagaaaatctttgcaaactatgcatctgacaaaaatctaataatatccagcatctataaggaacttaagcaaatctacaagaaaaaaaacaaacaaacaacccaattaaaaagcaagcaaaggacatgaacagacacttttcaaaagaagaggtgcatgcagtcaataagcatatttttaaaaagcccaacatcccactgatcattagagaaattcatatcaaaaccgcagtaaggtatcatctcaaaccagtcagaatggctgtcattaaaaagtcaaaaaatagcaggtgttgtaaggttgcagaggaaaaggaatgcttatacattgttgacgtgagtgtaaattagttcaactgctgttggagacagtgtggctattcctaaaagacctaaggaccaaaataccattcaacacagcaatccgttactgggtatatacccaaaataatataaatcgttctctcgtaaagacacatgcacacatatgtttattgcagcactactcacaatagcaaaaacatggaatcaacctaaatgctcatcaaagagagactggataaagaaaatgtgatacaggtataccatagaatactatgcagccataaaaaagagtgagatcatgtcctttgcaggaacataaatggagctggaggccattatctttagcaaagtaagacaagaaaagaaaaccaaacactgcatgttgtcatttgtaagtggcaggtaaataatgagaacacatggacacatagagaggacaacagacacagggacgtaccagagggtggggaatagaaggagtgagaggaccagggaaaatgactaatgggtactaggcttaatacctgggtgacaaaataatctgtacaacaaatccccatgacataagtttacctgtataacaaacccgcacatgtacccctgaacttcaaataaaagttaaataaaaatgcacggcttttgagaaaacattattagtacagtaaatgtgtctgtttatcctactacaggaaagcctatagttgtggctacccactttgagataaggtctaacaggaggaaaatgagagtaccttcatactactggtgcaaacattattttttccactggcagtggtctgagaacataggccttctagtgcactaatattcttctcatcaccactagcaactcatcccttattcttacttgattgctgtctgtggtataaaagtaaggtgttactacatgagctttttgcagtagcaaagccagtatatttaatcatcaatgttgttctcaggctagtgtctttcattgtgtttatcaaagctacactgctgcctcctcaatccagagatatgggaaaccaactggatagaggggtgttgataccttactttgctgttttacaagcaaatcagaggactgtcttgaatggacccactagattggaagttccctgagaacatcttattttttcattttctctaatgtatctccagtatctatagaggtgtcagtatataatagatgtttaataaatagtttttaaataatgaatgattaattattaattattgaatcctaggctgggttgaggtggtctttattagtgacctgttggggtccacttttaggggcagcatcatgaactgcataacatctatctttgactgtcttggtattgcaggttcaaacttcataagttggtccaactcctatttcttctccctcctgagtggactcacagtgggtgtaagaattggcggacaatttgacatcaagagcttgaccttggtaggtgcttggagcctccagtcctctttccatagactttgatggcaggctttatttcttcaaaggctggatcttttctctttcaggtgatatgcagttaggaatttgtctcatgaattctagtcctgctctaaacagtggtcctcagtttctggactagtggagtggttctggctagatctgtgggctccttggtgtggggtccatgtggcaaggcctcacacacagggtagcaactccaacctcccaaccaaccttatgcattctcaatatttttgagacatatttgaatcatgacttgacactgtttctgtcccatggtggagcgctacccaagaatgtctccagttttgagtaacaagcagcttgtggtgatgaatcaaacaggacggctgtggttcctactttcagcaactgtgctgagctggagagtaatcagaactggttagagtatttctcacatcagactccttgagagcccttttctttactaaatttcagagattttagaaatcctgagttcttagactttgcagtaaaaataaataggcagtttgacgttttcaaaaggatatttttgattcaataaactcctaatgttttatctatatttatttatttttgcttgttgtacccagctccacacagagttctcccacattttcaatttgtaatttaattcatgtcctgtggtgttcctttggcttattctaagaactatatgaatggctttgatgaactgtttctctaagctagtatttcaacaatctgacagacagagagactcatctctaaggaggtaattcagcctagagggcggttaagtatcacacatccaaaacatgacagagaaaaatttttaaaaagttttattgaagttatgagtcacatagttgggctcttagctctgcagatttaaaaaaatcaaacaaaaataaaaacaaaacacgaagttaaacaggacaaaataaatgtaaagtagaaaatactaattgtttctaaagatctcttgaaaagtctccagggagggacaagtggcatcagcgaggatcacggacttattggctgggtcctgtgcagaactgttggacccacaatttccctgtttgtaaaatatggttattaagagcacctggcttatcgagttagaaaattaaatgagttcatagtagtcacttagggttttctagcacctaataagcaaataagtttttgatcttacaattattctaatttataagcctagcaatacttctcattttctctcttcctttatcttaatggtctcagtccacaccttccacattactacattccctaagctctcagctccatttctcccctgacccaggacttcttaagctttaattaattctactccctccaccttctctctctgaagatttaattgtgtatgtggagttatctgtttttcctgagaccagctttttcttttttcttttcttttctttcttttctttttgaaatggagtttcactcttgttgcccaggctggagtgcagtggtacaacaggctcactgcaacctctgcctcccaggttcaagcaattctcctgcctcagcctcctgagtagctgggattacaggcatctgccactatgccaagctattttttttttttgtatttttagtagagactaaccatataacatgtggtttcatcatgttggtcaggcagtctcaaactcctgacctcaggtaatccacttgcctcagcctcccaaagtgctaggattacagacagctgaggccatgtttttctttacccatcttttaattgtagtctaaaggttttcagccttgcaattattggacttcttggggcagataattctccactgtggggctgttctatgcttagtaggaggcttagctgcatccctggcctctacccactagatgccagaaattctctttctacctctaagttttgacaacaaaaaatgtcccttggagagtcaaatttacccctttagaagaaatgctaattctgcctatttttttgataattgcctgctacatcttcactgttttgtaatagagatgtcagaaacatctagtagctagctcctcctacgactggggagtccattatgagaggacaatcacatttcagtcattcttttctgacagttagaggcctcactacaacccctctcatcacatcctgtcccccactgccgcacaattccagcagaaaaggactcgacagattcctgaattttgcagacctagagctagaattctgcatcttccctgtggtggtgctggatgtcaggggcagacaggagggcacacttccagccccacctagggagagacagagtgaaatgccaagggagacaccagtggtaatgaggacaaggagctttattttttgatgaggtcaggcacaagcactgccaatccttcacaggtacaggggtaagggaacatgtgacatcctggacatcagacaggaagtgccttctggggagagctcagaccttccacaggaaaacccctagctcagcctgtgaaagccagaagagggtatctgggaactcatgcatcaagatggggttttcctgggcccttgggattcttgtttcctccaaaatcgcttgtctcagcatcaggatccaggtcagcagcagcctccagagccatggccgcagccagagcccccgccttgctgaccactgcccctgtcacaggagttgggcctctggcgccggcatcggtggtggcgcctgtggtggttcaggaagcagccgccctcggagctagggccacagcccccagagcttggggcacagccagaggaagctggaggcagacactgtactgggctctttgggggacacttgggtgagggacacttgggtgggggttggcactgctgctggttctgctggcaggacatcttggcaggagttgagttgtcctggacaaaacaaagccatttgttagtccaaaatctacagtccaatgtctctaagaccagcggcctcctgaggcaagagctgcaggaaggtgagggaagctgatgtggagttggtgggacatgccagatgcctctcactttgttctccaccagggacagattgctgtgagtctaagtgggcatccatgtttctgtttctccaaagagcctctaggaatgtacccttttgacaaaaggcattctggagaatggagatcataggaaacatgtgccagcctgagtagaaagaggatgggaaggaatcataagcttctgtggcctttgcaggtcatggaattgctgtcagttcctgcagggtctccctcctggccccagttcccacattggtaccctctctgccatcctctctccgggcttttgtttcagatctctccatttccctctcctgctatgaccttagttttctgttccaacatcccaagttgagtcccatcccctgctggacactcaccaggtgcagaggaggcaggagaaggctgttcctgaggagacggtggatgaggagcccagggcaggagtgcttttatcttgtgcacggtgtgtgatgcacagcctgggcatgctgctgctttcacaaccaggggaggtgtcaacaaggcacacgcccaagactaggtttgtagctttggcacttccataatatccaaccaatgacattgaacctggaagcaggatcactgtccacatacctctcacctgggaggctaccactgcttcttttcttcctcccttcttccttgtttcaactcacgtgctgtggagcacagtctgtcctttacaatttcctgggaattagtatgacataattctttcttgagtcatgactggagaaataatagtcatttcaacaaatagagatgaaataattggacgtccatatgtaaaagaaatcatacctaatgctagatataaaaattaatagatcataatttaaaaaattaaactatgaaacttctgcaataaaacataataaatctttgtgactttgggttatgcaaaatttttcagatatgccaaaaaggtacaattcaaaaaagaaatataggacttcatcaaaattaaaaacttctgcttttcaaaaggcactgctaggcaaatgcaaagaaaattcacagacttggagacaatattgtaaaacacaaatcttaccaaggacttggttcaagaattttttttttatttttattttttgagacggagtcttgctctgtcgtccagactgaagtgcagtggcgcgatcttggctcactgcaagctctgcctcccgggttctcgccattctccctgctcagcctcccaagcagctgggtctacaggcgcctgccaccacacccagctaatttttttgtatttttagtagagatggggtttcactgtgttagccaggatggtctctatctcctgacctgtgatccacccgcctcggcctcccaaagtggtgggattacagagccactgtgcccggccaatgttttttaaattctcaaaaataggtaataacacagaaaatatgggcaaagtatttgaagagtcattttaacaaagaagatatatgggtggcagttaagcacatgaaaagatactcaacctaatcagtcattagagaaatgcaatttaaaagcaaagtgagataccactctatacacattggaatggctaaaatgaaataaatgacaatatcaagtaatatgagggatgtagaacaacaagaagcccaagtcattgctggtagaaatgcaaaattacattagttggcagtctatcaaaaaaattaaacatacaacttacaatttgccccagaaatcctattcttagatatttagccaaaagaaatatagttgtatgttcacagaaaaacctgtagcccaacatttatagtggctttattcataactgccctgaatttgaagaaccccacaagatcttcaactgatgaatagagttttaaaaatggtatatttatgcaatggaaggctacttagcaataaaaaaggaatcaactactgatatataaaacaacagggatgaatctcaaatgcaaaagaagtcagactttacatactacatattatataattttaattatagggcattcttgaaaaggcaaaattataagaactgaaaataggtcagtggttgccaagggctggtatgagggagaggctgatttaataagcagatgagggaatattttgaggtgatagaactgttgtatgtcttagttgttgtggggtttacctgactatatatgttagttaaagctcatagaattggataattaaatggatgatattttggtatacaaaatctcaagaaatgaaacttaaaatagaaaaaacaattaaaataacaatttttagaaataaaaaataatgaaatataccaaaagggaagcaaagaatgatgaatacaagatttaggatcatggttatattagatgggacaggcagggacatgggtgaaggctgaattacacaggtgcatataatttactatcaaagttatcattttcgcttggatggtgaatttttgtgtgtttgttatttaaataatagacaaacaggtaggcacattaattaagaaggccaagcatggatgaattgtgagcatataatatgaacagagggtatttgttaatctaattttgtgcttctgaaatccaatagtaagaaaattaaatgacataaactccacgacaacttggacaacttcccaagttgccattgatggcttgctcatctcatcttccccaagaatgactcagctgcttttcatagcatcagtcatatattgcaaaggagaagggttgatccttggttggttgtttgtccactcatttattactaatatgacttctcagaagattcaccctggaactagacctcagataaagcacctcctggcccagagtcaacatgcttgttattaggtcataacatcctcattttgagccagtcaagtaaatttcttcttcattatcccaggtcctcaggatgtcagggatactaagaagttctcacagtgcagaacatttggagctgctccatgctctgagagaagtaactgggctgtggactgtgttctgagaagaacaagtggttggagatttcataagagatgtgtgagattaaggagttccatcccaagaagaaaaagaatgtctccaaattaggatatggagacagaaactcagaaagggacccagtggtggagctaagaaaaagccagctacaagtcagctttcaattcatgaggaaaggtggaccctcctgctgacaagttctgaaatgctttgagtcacactgacaggcggacatgtgttatactcaaaatgaagtcttacagcaattcaaagttgtacatcattaggagtaaatacggactctgtacttatttctggacaacgactgtacatggaaaagtaattattcacttctgaagctaggtttgaactccaagacaaagacagttctctcacccacactataatgcctacattttgcctttgggctcagtcatcacagatataaataccatatttgtgtagtgtctatcttctctgctaggttgtaagatccctgaagaaagtaaatgtgccccttattcagtgctgaaacccaagctgagcaagccacttactggccttagcagatattcagcttgtgtttctcaaataaaggatgatgagagtcaattccaacatgtaagattggtgatggcatgtcggaaagagagaggctcagatcaaactttgggcttgagaagaaaagttatagagtgatgtctccagtgagggttgcagatcaggggtcagggtagacccaacagggcatctgggactctctgggagcaccctctcactcctctcactcaggctgccccattcctgttctctaggttttaggtctgacaccactggcattttttccgatattttttttccactctcttggttg

SEQ ID NO: 277 - DNA, 24971 bp, Homo sapiens
attatgagaggacaatcacatttcagtcattcttttctgacagttagaggcctcactacaacccctctcatcacatcctgtcccccactgccgcacaattccagcagaaaaggactcgacagattcctgaattttgcagacctagagctagaattctgcatcttccctgtggtggtgctggatgtcaggggcagacaggagggcacacttccagccccacctagggagagacagagtgaaatgccaagggagacaccagtggtaatgaggacaaggagctttattttttgatgaggtcaggcacaagcactgccaatccttcacaggtacaggggtaagggaacatgtgacatcctggacatcagacaggaagtgccttctggggagagctcagaccttccacaggaaaacccctagctcagcctgtgaaagccagaagagggtatctgggaactcatgcatcaagatggggttttcctgggcccttgggattcttgtttcctccaaaatcgcttgtctcagcatcaggatccaggtcagcagcagcctccagagccatggccgcagccagagcccccgccttgctgaccactgcccctgtcacaggagttgggcctctggcgccggcatcggtggtggcgcctgtggtggttcaggaagcagccgccctcggagctagggccacagcccccagagcttggggcacagccagaggaagctggaggcagacactgtactgggctctttgggggacacttgggtgagggacacttgggtgggggttggcactgctgctggttctgctggcaggacatcttggcaggagttgagttgtcctggacaaaacaaagccatttgttagtccaaaatctacagtccaatgtctctaagaccagcggcctcctgaggcaagagctgcaggaaggtgagggaagctgatgtggagttggtgggacatgccagatgcctctcactttgttctccaccagggacagattgctgtgagtctaagtgggcatccatgtttctgtttctccaaagagcctctaggaatgtacccttttgacaaaaggcattctggagaatggagatcataggaaacatgtgccagcctgagtagaaagaggatgggaaggaatcataagcttctgtggcctttgcaggtcatggaattgctgtcagttcctgcagggtctccctcctggccccagttcccacattggtaccctctctgccatcctctctccgggcttttgtttcagatctctccatttccctctcctgctatgaccttagttttctgttccaacatcccaagttgagtcccatcccctgctggacactcaccaggtgcagaggaggcaggagaaggctgttcctgaggagacggtggatgaggagcccagggcaggagtgcttttatcttgtgcacggtgtgtgatgcacagcctgggcatgctgctgctttcacaaccaggggaggtgtcaacaaggcacacgcccaagactaggtttgtagctttggcacttccataatatccaaccaatgacattgaacctggaagcaggatcactgtccacatacctctcacctgggaggctaccactgcttcttttcttcctcccttcttccttgtttcaactcacgtgctgtggagcacagtctgtcctttacaatttcctgggaattagtatgacataattctttcttgagtcatgactggagaaataatagtcatttcaacaaatagagatgaaataattggacgtccatatgtaaaagaaatcatacctaatgctagatataaaaattaatagatcataatttaaaaaattaaactatgaaacttctgcaataaaacataataaatctttgtgactttgggttatgcaaaatttttcagatatgccaaaaaggtacaattcaaaaaagaaatataggacttcatcaaaattaaaaacttctgcttttcaaaaggcactgctaggcaaatgcaaagaaaattcacagacttggagacaatattgtaaaacacaaatcttaccaaggacttggttcaagaattttttttttatttttattttttgagacggagtcttgctctgtcgtccagactgaagtgcagtggcgcgatcttggctcactgcaagctctgcctcccgggttctcgccattctccctgctcagcctcccaagcagctgggtctacaggcgcctgccaccacacccagctaatttttttgtatttttagtagagatggggtttcactgtgttagccaggatggtctctatctcctgacctgtgatccacccgcctcggcctcccaaagtggtgggattacagagccactgtgcccggccaatgttttttaaattctcaaaaataggtaataacacagaaaatatgggcaaagtatttgaagagtcattttaacaaagaagatatatgggtggcagttaagcacatgaaaagatactcaacctaatcagtcattagagaaatgcaatttaaaagcaaagtgagataccactctatacacattggaatggctaaaatgaaataaatgacaatatcaagtaatatgagggatgtagaacaacaagaagcccaagtcattgctggtagaaatgcaaaattacattagttggcagtctatcaaaaaaattaaacatacaacttacaatttgccccagaaatcctattcttagatatttagccaaaagaaatatagttgtatgttcacagaaaaacctgtagcccaacatttatagtggctttattcataactgccctgaatttgaagaaccccacaagatcttcaactgatgaatagagttttaaaaatggtatatttatgcaatggaaggctacttagcaataaaaaaggaatcaactactgatatataaaacaacagggatgaatctcaaatgcaaaagaagtcagactttacatactacatattatataattttaattatagggcattcttgaaaaggcaaaattataagaactgaaaataggtcagtggttgccaagggctggtatgagggagaggctgatttaataagcagatgagggaatattttgaggtgatagaactgttgtatgtcttagttgttgtggggtttacctgactatatatgttagttaaagctcatagaattggataattaaatggatgatattttggtatacaaaatctcaagaaatgaaacttaaaatagaaaaaacaattaaaataacaatttttagaaataaaaaataatgaaatataccaaaagggaagcaaagaatgatgaatacaagatttaggatcatggttatattagatgggacaggcagggacatgggtgaaggctgaattacacaggtgcatataatttactatcaaagttatcattttcgcttggatggtgaatttttgtgtgtttgttatttaaataatagacaaacaggtaggcacattaattaagaaggccaagcatggatgaattgtgagcatataatatgaacagagggtatttgttaatctaattttgtgcttctgaaatccaatagtaagaaaattaaatgacataaactccacgacaacttggacaacttcccaagttgccattgatggcttgctcatctcatcttccccaagaatgactcagctgcttttcatagcatcagtcatatattgcaaaggagaagggttgatccttggttggttgtttgtccactcatttattactaatatgacttctcagaagattcaccctggaactagacctcagataaagcacctcctggcccagagtcaacatgcttgttattaggtcataacatcctcattttgagccagtcaagtaaatttcttcttcattatcccaggtcctcaggatgtcagggatactaagaagttctcacagtgcagaacatttggagctgctccatgctctgagagaagtaactgggctgtggactgtgttctgagaagaacaagtggttggagatttcataagagatgtgtgagattaaggagttccatcccaagaagaaaaagaatgtctccaaattaggatatggagacagaaactcagaaagggacccagtggtggagctaagaaaaagccagctacaagtcagctttcaattcatgaggaaaggtggaccctcctgctgacaagttctgaaatgctttgagtcacactgacaggcggacatgtgttatactcaaaatgaagtcttacagcaattcaaagttgtacatcattaggagtaaatacggactctgtacttatttctggacaacgactgtacatggaaaagtaattattcacttctgaagctaggtttgaactccaagacaaagacagttctctcacccacactataatgcctacattttgcctttgggctcagtcatcacagatataaataccatatttgtgtagtgtctatcttctctgctaggttgtaagatccctgaagaaagtaaatgtgccccttattcagtgctgaaacccaagctgagcaagccacttactggccttagcagatattcagcttgtgtttctcaaataaaggatgatgagagtcaattccaacatgtaagattggtgatggcatgtcggaaagagagaggctcagatcaaactttgggcttgagaagaaaagttatagagtgatgtctccagtgagggttgcagatcaggggtcagggtagacccaacagggcatctgggactctctgggagcaccctctcactcctctcactcaggctgccccattcctgttctctaggttttaggtctgacaccactggcattttttccgatattttttttccactctcttggttgcttttcagcctcaccatccagtttgacataaaaaagcacattgcacctgttatgggacagtcactagaagagctaatggctgctctcagtgcagcagttaagctgaaaatgcaaatacacctagaaacccggaagggaatgaggatcttatgttgaagaccgagaggacttttgtatatggggtgagataagggtccagtttcattcttctgcatgtgaatatctagttttccccaaaccatttatttaagaaactatcctttttccattgtgtgttcttggcacctttgtcaaagatcagttaacaggaagtgtgtgtgtgggttaatttatgggctctctagctctctattctgttccattgatctatgtgtctgtcttttttttttcatgctgttttgattactggagctttgtagtacatttgaaatcaagtggtgtattacgtccagctttgttcttttgtccttaagattgctttggctattcagggtattttgtagttccacatgaattttaggatttaaaaaaaattctattttatttttcaagatggtatattggaggctttagcatgactcttccacttggaaatagcaaaataatgcataaagatcaaaattatggctttaattcaagaacgaaaatgggaattcactggaaagcaaaagacatcacagttcctaaggaggcgaaaatgggcaaacaacccttgttatagagtccagctgaaaagtgagtgaagccccaatatgtgagaggggcacacattatgacttagctttctaatggggatccatgcaacccaggccaaaggagagcatcatatttctcccatgccctggagctagcttgagaagaggttgggagacactgagagggaaagacactgggaaaagctgcggagattttcccgaacccagtactgaaagcaggatgccatttttaatccaggcacatacaaagtcagccattctctgatgacttggcagtatggctgtgcaggcattttagtcttgggccagagagtggagcacttaccctggagtagggtaggggtctctacagccataatctaatggcaagtgtggaaagtgccccacaagtaggtgctggaactgtgttctcccctatcaccgcagtaggagaactactgcagctgctgtttcttctgggtggtaagacttgcagccagggccacctggtgtggagacccggaattagtctgtatgtgtcattcatgggtgctccagcctgctcccctgagactgtgctgcagcagggcaatttctgctccatgctcccacagatcttcagacattcaggactccacttgtctggatcagcagcctgagctgccccattcttccagtgcagattgtggtaaagcagggccctctatgctttatgcctaggcagatattcaggcatctggagcacccactctcctggattaggagttcaagctgccccccaacacttccatgcagagaacttggggccaaggaggtttcccagctccaggcctaggcaccccactgggagcctttctcccttggtgctggtgcttgtgcctgccattggaggatctgttaggtgggctgcccagtgtggctctacccatctttgtatgcccccaaggactgagcagggagctcaaaccactgagcaccccacagatcagcccattgcctgaggcaattcagagcttctgtccgtaaacaagtatcaaatatatacctatttgcattgaccactgctggcttttactcataagcaccatctactggcctgtaggtcaaactgatcagcccaaaataaaacctgccaatagaagtgcctagggcatagggctacagaagtagtcaaaagaccctagccaacattttctacagtcacaccttctagggaggaagggggaaggaaaaaaaaaaaaagaacaaatcaataaaattatagggaaataaataaagaaaaaatcttatccacatgaaaatatttacatagaagtgctaggctagcatcaccagatgagaaagaactagcacaaggactctggtaccatgaaaagtctgaatgttgtgacacctccaaaagatcttcagcaatggtccctaaccaaaatgaaatctcaggaattacatataacaaattcaaaacatgaattgcaacaaagcacaatgagatcgaagacaaggttgaaaatcaacataaagaaacttctaaagcaatgcagaaaataaaggaagagataaaaaatcttaaatcaatcagagattctgaatttaaaaactcacttaaagaaattcaaaatatgattgaaagctttaccactagactagaccaagcagaagaaagaatttcactggtatgaataccaatcttttgaactaatccagtcagacaagaataaagaaaaaagaatttaaaaaacgaacaaagtctttgaggaaggatattctgtaaagcaaccaaacctacaaattactggcatttccaagaaagaaggagaaagagtaaacaacctggaaagtatatttgagggaataactcaaggaaattcccctcatcttgctaaagaggtagacattaagacacaagaaatatagagaatgtgtgcaagatactatacaaaacaaacatcaccaaggcagatagtcaccagactgtccaagattaatgctaaagaaaaaaatcttaaaggcagctagagaaaaaggtcagaccacatacaaagggaagcccatcaggctaactgcagagttctcagcagaaaacatacaaatcagaagacattgggggctcattttcagcatccttaaagaaaagaaattccaaccaagaatttaatcccctatcaaactatgcttcataagcaaagaagaaataaaatcttttccagaccaatgattactaagggaatttgttaccactagactaaccttacaagaaatctttaaaggagttctaaacatggaaacaaaagaacaatacctggtccacaaaaacacagttaagtacatagcttgcagaccccatgaagcagctacacaatagaaactacaaagcagccagctcacaacttcacaatcaaaacttcacatatcaatatgtgggcttgagtataaatggtctgcaggcccaatttaaatggcacagaatggcaggtaggatgaaaaagcaagacttatccatctgatgtcttcaagagacccatctcaaatgtagcgacaattataagctcaaaggggttggaaaaggatctatcatgcaaatggaaaacaaaacaaagtgggagtcaatattcttagataaaatagactttaaatcaacaaaaactaagagaaaaaccaaagaaggcaattacataaaaataatgcattcaattaaacaataagatttgactatcctaaatatatatgcattcaacattggggcactccagttcataaaacaagtacttctaggtatatgaaaagaacttagccacacaatgatagtgaggacttcaacactccattggcagtgttagacacatcatcgaggcagaaaactaacaaattctggacttaaattggacacttgatgaattgggttaacaaacttctacagagtacttcacccattaatcacaaaataaattcttctcacctgcacatggaacatactccaagattaaccacatgctcagccataaggtgagtctcaataaatttaaaaaaattgaaatcatacaatttatacttttggaccacagtggaataaaaacaaaagtcaatactaaggagatgtctcaaaaccaaacaattacatggaaattaaacagcttgtttctggatgaatttgggggaaacaacaaaattaaggcagacataaaaaattctttgaaataaatgaaaacagagataaaacatccaaaaagttaacaacctaacatcactcctagaggaactagggaaatgagaaaaattaacccaaagttagaagaaaagaaataactaaaatcagagcaaaactgaatgaaattaagatccaaaaccacacaacttcccaagactaaatcaggaagaaactgaaaacttgaccagaccaacatggagctccaaaatggaattagtaattaagaaaccgtaccaaccaaaaaaagccctagaccagatggattcatagctgaattctaccagaggtacaaagaatagctggtacccattctactaaaactattccaaaaaattgaggaggaaggactcctccctaactcattctatgagtccagcatcattctgatactaaaaatctgggaaagatagaatgaaaaagaaaaatataggtcaatatctcagatgaacagacacaaaaatcctcaacaaaatactagcaagctgaatccagcagcacaccagaaagttaattaaccacaatcgagtaggccttattcctggcatgtaggtttggttcaacatatgcaaatcaatataagtgattcacctcataaacagaattaaaaacaaaaaccttatgattgtctcaatagtgcagaaaaatcttttgataaaatctaacatcctgtcataaaaaccctccacaaactaggcattgaaggaacatacctcaaaataataagagccatttatgacgaactcacaatcaacatcatacagaatgtgtagaatctggaagcattccccttaagaacatgaagacaaataggctccttctcaccactcctattaaatctagtagtggaaattctagtcagagcaatcaggcaaaagaaagaaataaaagacatccaaataggaaaagagtaagtcaaattatctcttttctctgattctgtacctagaaaaccctaaagactctgccctaagtttcctagaactgataagcaacttcagtaaagtttcaggatacaaaatcaacacacaaaaataagtagcacttctactcaccaattacgttcaaactaagagccaaataaagaatgcaatccatttacaatagacccccaaaaatacctaggcatacatctaaccaagatggtgaaagatctctataaggaagactaaaaatcactactgaaagaaatcgtagatgacacaaacaaatcggaaaacattccatgctcttggattggaagaatcaatgtcgttataatgaccatatcgcctgaaacaatctacagattcaacactattcctatcaaactaccaatataatttttcatggaattttgataaaaactactctatattcaatatggaaccaaaaatgagccaaaatagccaaggcaattctaagcaaaaagaacaaatttggaagcatcatattacccaacttaaaccatactgtaaggccactaaccaaaacagcatggtactggtacaaaaacagacatatagaccaaaagaacagacagattacctagaaataaagcaatacctctatagccagctgatttttgacaaagtcaacaaaaataagcaatagggaaaggattccctattcaataaattatgctgggataactggctatccatatgtggaagaatgaatctggacccctaccattcatcatatacaaaaattaactcaaggtgaattaaaaatgtaaatgtaagacctcaaactataaaaattctggaagaaagccaaagaaatacaattctgaacatcagccttggcaaagaatttatgattaagtccccaaaggcaattgcaacaacaagaaaagtcaagtgggacctaattaaactaaagagcttctgcacagcaaatgaaaccatcgcagagtaaacagacaacctacagaataggagaaaatattcataaactatgcatacaacacagttctaatatccagaatctttaaggaatttaaacaattcgacaggcaaaaaaaccccacaaataaccccattaaaaagtgggcaaaggacatgaacagacacttctcaaaagaaggcatataagcggccaataaacatactcaatatcactaatcatcagagaaatgcaaatcaaaaccacatgagatactgtctcacaccagttagaatggctattattaaaaagtcaaaaaataacagatattggcaaggttgtgcagaaaaggaaatgcttgtacactgctggtgggaatgtaaattagttcagccactgtggaaagcggtttggagatttctcagagaacttaaaacagaaatgctattcgacctggcaatctcattactgggtatatatccaaaggaaaataaactgttctaccaataataatagtaataataataacctatacactcttaaattcatcacagcacaattcacaatagcaaagacatggaatcagcctagatgcccatcaacagtggattggaaaattataacgtggtacatatacaccatggaatattacacagccatagaaaagaatgaaatcacgtcttttgcagcagtgtagatccaactggatgccattatcctaagaaaattaatgcaggaacagaaaaccaaatacttcatgttctcacttataagtgggagctaaatactggatacacataaacataatgatggcaacaatagacactagacaactagaaggggagagaggaaaggatgcaaggagtggaaaactactattgggtatatgctcactacctgagtgatgggatcatttgtacccaaaccttaacattgtgtaacatactaatataaacaatctgctcgtgtacacctgaatctaaaataaaagttgaaactgtaaaaacaacatcaaaaaattctgtcagaatgtcattggaattttgatagacattgcagtaaatctgtagattgctttggggaatatggacaatttattcatttatttattttaatgtatattatttttaattgacaaactagaattgtattacatttattgagtacaatgtaatgttttgacattttgtgtagtgatatatttgaaatttgctctctctattttgaactaagccatacataattattgactgtattcactctcctgtgcgatagatcttaaaacatatccctgctgtctagctaaaaattttaagtttttgattaacaaatccccaagtcctttgctgccctctccctctagcctctgttaactaccattatactgtctgcttctatgaattcagctatttttagattctataaataagtgagatcatgcattgtctttccatatctggcttatttcacttagtgtaatgtcctttaggttcatccatgttgtcacaaatgacgggatttccttattttataaggctgagtagtagtctattgtgtacgtatactacattttctttctccattgatagacacaggtttattccatatcttagatactgtaattaatgctgtaataaatatgggaatgtagatatccctttgatacaacgatttcaatgccttggatatattttcagaagtaagattgctgaatcatattttagttctatttttagttttttcaggaacatccatatcattttgtataatgtttattataatttacattcccaccaacagtgtacaagtgttcccttttctctgcattctcaccaacacttttcttttctttttttctttttttagatatataagccattctaacaggtgtgagttgttatcttactgtggttttaatttgcattttcctgataattagtgatgctgagttttttttttttcctaaacccgttggtcatccctaggtctttgtttgagaagtgtctgttaaagttctttccccatgttcaaattttttttcttgctactgagttgagttcattacatattttggatattaaccctttatcagatatatggtttgcaaattttttttccactctgtgggttgtctgttcactttgttaattggttctttggctgtgcagaaggtttttagtttaactaacaaaagcaatccaatttttctatttttgctttcgttgcctgagctttcagggtcatattcaaaaaattattgccccgagcaatgtcatggagctttccccctatgttttcttctaatagttttaaagtttcaggtattatgtttatgtctttaatccattttgagtttatttttgtgtatgctgcaaaataaaggtctaatttcacttttatgcatgataaccagttttcccagcactacttattgaagagactgtcctttacccattgtgtgttcttggtacctttgtcaaaagtcaatcgactgtgaacgcttaggtttattccctggctttctactaaattgttccatttgtctatgtgtctgtttttatgcaagcactgtgctgtttttactactgtagctttgtagtagatttcaaaaataggtcaggtgatatccccagctttgttatttttgttcaagattgccttgaactgtttgtggtcttttgtgctttcacgtgaatttaaagattatttttggcctggcgtggtggctcacacctgtaatcccagcactttgggaggccgagacgggcggatcacgaggtcaggcgatcgagaccatcgtggctaacacggtgaaaccccgtctctactaaacatacgaaaaaattagctgggcgtagtggcgggcgcctgtagtcccagctactcgggatgctgaggcaggagaatggcgtgaaacctggaggcggagcttgcagtgagccgagatcgcgccactgcactccagcctgggcgacagagcgagactccgtctcaaaaaaaaaaaaaaaaaaaaaagtttttttttctatttctgtgaaaatggcaatggaattttgatgtaagttgtattgcatctacagatcacttcgagtaatatgaacattttaacaatgttaactttttcaaaccatgaacatatttttatatgtgttttcttaaatttatttgattagtgttttaatagtctttagtatacacgtttttcacctccttagttaaatttacacctaagtattttattttctttttttgctgatgtaagtgggattgtttccttagttttctgcttggataactcattattagtgtatagaacactacttattttcatatgttgattttgtgtcctgcaactttactgaatttatcagttctaacaagtttttggtggactctttagaattttctttatatgagattatattgtcagcaaatagaaacactttcattaattccttttgtcttaggattccttttatttctttctcttgcctagttgctctggttaggacttccagaactatgttgtaaagaattgtgagagtgggcctccttcttttattcctaatcttagagaaaaagctttcaacttttcatgattaagtacgatgtttgctataggtttgtcagatatggcttttattgttttgaggtacatttcctttatacctattctattgagagtttttatcatgaaaggatattgagttttgtcatatgctttttctgcatctaatgagttgattacatggtttttattcttcattttattagtggaatgagtcacatatattcatttgtattttttgaaccatcctcgcagccctgggtaaatcccatttgatcagggcagatgattcgtttaacatgcggttgcatttggtttgctagcagtttggtaaggatttttgcgtttaggtttatcaaaggcattggcctgcaattttcttttctcggagtgtccttgtctggatttggtatcagagtaatgttggtcttgtaaaatgagtttgaaagtattccttcttcttcaatattttggaagagtttcagaaggattggtatacaatcttctttaagagattggtagaatttatttctaaagccacccagtcctgggcgtttctttgataggagactgttactgatttaatcccttatttattgctgatttaatccctttactcactattggtctgttaaggttttctattcatgagtcagttttgttaggttctatgtgtttaggaatttataaatttcttctagatatccaattatctggcctacagttgttataatcatttgtatttctgtggcatcagttataatgtgtccactttcatttctgatttttatttctttgagccttctttctttttttcttagttagtctagctaaggtttgttgattttgtttatctttaaaaaaataattatttgtttcattaattttttctactgttttcctaggctctattttatttatttctgcttggatctttgtcattcctttccttctcttaactttgggcttagtttgttcttctttttctagttccttgagatgtaacattacattgtttatttgagatcttttgtctttttgatatagacatttattgttattattttccctcttagcactgcttttgctgcatcccacaaaatttgttttgttgtgttttcatttttgtttatctcaaggcattttttgattttctttttttatttcttctgtgacccattggtttttaagagcatcttgcttgattttcacatattttaaaattttataaggtttctcctgttacagatttctagtttgatgtcattggttggttggtatagttttaatcttccgagatttgttaagaattgttttgtggcctaacatacagtctattttagagaatattctatgtgctcctgagaagaaagtatattctgttgctgtttggtggaatgttttgtatgtgtctgttagttctctttggtctgaggtgtaattcaagcctagtgttcccttattaactttctgcttagatgagctgtctattgttgaaagtagagtattgagatttcctgttgttatggtattgcagtctatcattcccttcagaaaatttaataattgcattggtatatatgtgctcttatgttgggtgcatatatatttacaattatattcttttgatggcttagcactttctattgccgtaaaatgacctactctgtcttttttatagtttttgacttaaagtatattttatatgctataagtatagctaccatgctctctttgtttccatttttatgaagtatcttttcccatcccttcatgttcagtctatgtatgtccttagaaggaaagtgagtctcttgtaggcagcatatggtttgatctttaaaaaaatctattgagctcctctgtcttttgattagataacttaatcctgttacagtcaagacaatttttgatagtttaaacttactaccattattttcttaattgttttctggttgttttcttgatcttttgtttctttcttaatttcttgttctcttcctttgtggcttatagttttctgtggtggtcttctttgatttttttttatattttgttctacaggattttgctttatggctaccatggggcttatataaaacatcctaaatttgaaacaggctattttaagctaataactttaattacaaacagaactgcacattaattccctccttccccttgtatacttttgatatttacctagttttataatttatatctcttaattatttattgtagctacagttatttttaatagttctttttttaatcctcataggacagataaaattgttttatgcttcacccttacagttttagaatattctgaatatgattacatagtcatattacttataccattgagatatttacttttgtgtttttgttattaattagcagattttcattttagcttgaagaactccctttagcaattcctatggagcaggcctagtgatgatgaattcccttagcttttgtttgtctgagaaagtttttatttctgcctaatttctgaagagcagactttccaggtaatgtatccttggttagcacttttttcttcagaattttgaatatctcattctactttctcatggcctgcagaatttctgccaggaaagctgttaacagctgtattgggactgctttgaatgtgatgtttcttatctcttggtgttttttttttgtcttgcatttttgataattttattctagaattttttgataattttattctagaattaatgtttgggttgaatttacttggagacttatgagcttcctatacctgaatgctgtcatctttcttcagattttgaaaatttttagtcattattaccttaaatgtgctttctgggcctttgtctctctcttcttcttcttcagaaactcctattatgtggaggttaattctcttaatagtgtcccataatttctgtaggtcttttccattcttttttctttttactcctctaactggataatttcaaatatcctatcttcaagttattctttcttccacttgatcaagtctgctgttgaagctttctattgaattttatagttctgttattacatactttatctctaggatttctatttttattgtttctatttatttggcaatctcctcattttgttttataaattgttttccacatttaatttagttttttatctgtatttacttgtagtcccctataagtaatacgactatgtatcatattcagaatattctaaagctgtaacagtgaagtataaaaaagctttatctttcctgtgaagattaaaaagacacaactattaaaaataactgtaggtacaataaattattaacggatacattttacaaaactaggtgaattttttttttttttttttgagatagagtcttgctccgtcacccaggctggagtgcagtggaatgatctcggctcactgcaacctctgtctcccaggctcaagcaattctcctgcctcaacctcccaaatagctgggactacaggtgcatgctgccacacacgactaattttttgttttttagtagagacggggtttcaccgcgtttaagataattgttctgaattcttcatcagtcattttataaatcttcacttcttcaggatcccttattggagatttattaatttccttatgatgatgatgtattttttcagatttttcataatccttgtgtccttgcattggtgcccaaccatttgaggaaatggccaactattccgcctttgtttgtgttatttggccatggtataccttcactatttgatcaaacctggaattctgattaagcaagttggtggtgaccttgaacgggaagaccttgctgtcatgctctctagctgggctgaactgttaactgtactggttgagtagaatttctggctctgttccatggtctggtgagagaactggctggactctgtaataagacagagctgctggctgaaattgcctctgattgagcagtattgttggttgtcttccttagatggccagtactacagttttgaatatgtagttgggcaaggccatgttttaggtgtcaaggctgaacaaagactctgagattgctacctaaccatgcagggtgacaggaccagaggctgtgctccacagatacacatgggcatgggttcagctctaatcctgggatgacctaaggcagagcaccatggcttgatatattagccacttggatgctgggcctgggtggaacagatgctccttctacagttaattgccaccatgcccctgttttctggccttaggaagcgttaaggagcacaaagggcagggcttgactgggtgaaagcttggcagctgggaatggttggggccagatgttctctttgcaggtaattgccattctacccttatctcctggcctggggaagtttcaaggggagcactggggctgagtgtggaagctgagcagagattcaaacctggcagactaatcaactgtgcttcttgttgagcattgcaagcctctctggtggtgtgcctctgctggccagaatgcagagcaactatcaagacccctgaactggtcactgtgagtctcaccctgttctgagtttctaaataaacattgctaatgtttcctgtgggataagacaagagagtttcttctgcgaaggattccaaaatggtgggaaagctgaatgttcattctcaactctctcttccctctgtaaaagccatgggttctgggaatcctcttatgtgtgatgtgctggcttgagggagggacagtgtggtcaaagtaaaacctcctcttgctctacgtgtgtggtttttctcagtactgtggtccaaggggatgtctgtgcctcacttcaagttctgagatattcacaagggtatccttgtctgctgttggttgctagttggatttctgtggtgggactactggagtcagagaattcctattctattatatttctaacatctcccctagtatgaacattttagcaacattcacttttccagtctgtgaacatgtaatatctttctatttgtgtcttcattttctttcctcaatgttttatagtttttagtatacagatctttcacttctttggtaaaatttattcctaagtattttttggatgatattataaatgggatttttaacttctttttttggatagttgttatggtatgtgtaagtgctactgatttctgtacgttgattttgtattaaagtcttaaacataagacctgaaattttaaaactactggagtaaaacacagggggaaaacttcttgacattagacctgggcaaatattatttttgaattttgaccctaaaagtacaggcaacaaaataaaaaatagacaaatgtggttgcatcaaagtaaaaagcttctgcaaaataaagcaaacagttaatggagtgaagagacaacatacagtatgtgataaaatatctgtgaactacacatctgataaggagttaatattcaaaatattttagaaactcaaacaactcagtagcaagaaaacacataaaccaatcaaaaaagtgggcacagggagtttcccaaaagaagccatacaaatggcctacagtatatataaaaatgtgctcaacatcgctaataatcagggaaatgcaagttaaaaacacaatatcacctcacatctgctagaatggctattatcaaaagacaagaaataacaagtattggcaaagatttggagaaaagggaacctttttacagtattagtgggaaagtaaagtagtatggccattgtggaaaacagtgtgaagtttccttaaaaaattaaaaatgaaactactatgtgattcaacaatcccactactgggtatatagctaaaggaaatgaaatcagtattttgaagagatatctgcactcccaaatttattgcagcattgtttactacagtcaagatatagaatcaacctaagtgtcctttagtgggtaaatggattaaaaaacatgttatataagtgtaatggaatacaactcagccttatataaaaagggaagtttctaatttgtgacaacatgtataaacctgaaagatattatgctaagtaaaataagccagatatagaaagacaaatattcgtgatctcacttttatgtggaatcctaaaaagtcgagtgcgtggaagtagaaatgatcattatcaggggttgggttggggagtggggaagaactggggagatgttggtcaaaggatacaaaatttcaataagaccggagtaataaattcaggagatttattgtacagcatgatgactataacaatgtattgtatttttgaaaatttctaaaagagtagactttgagtggtcttattacaaaaaatggtaagtgtgtccagctgtcattcctggagaacacctgaaaaccatcaccctttgggaccatcagtgcaatagaggactgacttacaaaggctgtggtcttaggcttgaagtctttttaaacacttctgtgatagtgcttattctgtcagatcaaatatatttacttttctgagtgatagtccatttaggctgtaaggtgctcaatggaagaaatatgtccgatacatctccatactactactgttgaaagaagtaaaacgaacagagcttggaatgaacaagcagaggtgggcaggaggtacagggtggaccagagtgggaagtacttctgcagtcacgaggacatcctgcttccatcttattaaatctttaggcatgtgcccaggaagacacaggggtcatcttattacacctttaggcacatgctgaggcagcaggcaactgggaagtgtctggtgctgtcacctccctggttgtgaaaacagcagcatactcaggttgtgcatcatcgtgtacactgcacgggataaaagggctcctaccctgggcttctcatccacagcatccttaggagcagccttcttctcctacctcctctgcatctggtgagtggccagcaggggacagatcctcagctgggagtgtttgggaaagagaggcccagaactgaaatggaaccatcagaaagaagcccacagtgggcagcagtgggggaggtgatggagaataaggagcctctaaagcacatgtcagggacccgtgagctgcaaaacccgcaggaccttaggattccttcacattcttgtttggagcatgttgtcaggaatgcacatagatccattttatatttttaaggttgctttatccaaatgcatgtgtagggttccctctactacattcccatttctctcctacagatcttggcttagaaagtggcttcatcaagggggtcagtgtgtgacaaacccaaaaataaggagatggtctgagggttctgtgctcaaatgtttctattattctgttcaaggtaaaattcctgcattcctgcaaagatgtcctgccagcaaaaccagcagcagtgccagccccctcccagttgtccctcacccaagtgtcccccaaagagcccagcacagtgtctgcctccaccctcttctgactgtgctctaagctccgggggctgtggccccagttctgaaagtggctgctgcctgagccaccacaggcacttcaggtcccatcaatgccggcgccagagatccaactcctgtgacaggggcagtggtcagcaaggcgggggctcctgccgtggccatggctctgggggctgctgctgacctggatcctgatgatgagacaagtgatctttggaggaaacaaggatcccaaaggcccaggaaaagctccatcctgatgcatgcttttccagataccttgttctggctttcacaagctgagctgggggtgttcctgttgagtatccaagctgtccccagaaggtgcttcctgtctggtgtataggatctcacagttccctcatccctgcccctgccaaggattggcagttccctgtgcctaaccctgccaaaaaataaagcttcttgttctcattaccacggtgtctcacttgttaggaaactatccaggatttatccatccaggccaggttctcctgtcacccgaactcgcaggaccttagaaagccagagatttaagtgtgttacccctggtagaggtgaccccagagagctgacctcatgctcgggcaagtaactgggctgtgttctcccagccaaccctctgtcatcacaggacacctgctcagcctcagacctgtgtagtttttgctctgatgacaaacagaggagcgaggaattgggagcccctcatggaggggaggaaaggttgatgggcaccatcaccaggatgggtatggagcctcccaagccaggcatcagggttggggctgtggagaaactcatttgtggacatctgctgcattccataggaacagaaagggccccccattacagttctggggtgttctgaaacttcagaacttactcctctgttgttgtatcccaatgactacagattttactcctaagaagcaaaagtggtcactcagctatattcagccccacaatctggctaccatgagaaagtgcttggtctatctcttttaaatgtctctttgcaggacagaggccactgaagggacccttaacattaagagtaaagtggccacccaagagtagttcaagggataattcctgaaaatacttccaagacagagacaggggtcatgtgctggaggcaggaaaatgctgctgagaatatcaatacctaaacctaccctctccccagtccacattcagagccaccctctttcctacggcccagtgcctttatgctcccacaggcatcactatttcagtttgctagggtgggctgtcaggcagaataagaagacaaaaattataaccccaatagtgaacataatttaatttttgttgacaattataatttaatttaaatatgtataaagtttgattacagcctgactgatttatcttgaaaaatatctagaaaaaggtacttattttaatattagagattaattgaatgagaaatttatctacaattaaaatgaaattcgcagagaaaatagcattcagtttgcatcaattctccgtacccaaaatatagacatgatcaggtcagctccattacatgagatgcacccagcactaccatcaacctcaaaagcagcaacacataccaaagtcatcttcatcaagcccatccattatcatgcatgcttgcagaacttcatttcgagtccaagcagatgaacgactcctccctctgtgttttcatggtcttcaaataaagagcacacattccctggattttgatggaaggtcatgccttttgtaatgtgcttactgtgactcttggcactccaattgttgtactttccttctccatatttgcccctcaatcaggtattcatttggctcccctcctctcctgcccaggggcctatgttacctcctgggtaccagtgaggctctttcaagagtcctcatctccgctgactttacccttccatctgttttacacacagcccattctgaatgtccagcatccttacctcagtcaccaccccaacagcaagtgctgatcacatctgatgcttgattttcctaagggaacattacagaaaaaagtagatgggcaaagaaccatggacttcgtgggtagtcatttacattgcagtacttatctcatggaagcagtctccctatttacttgactgcctgtgcagttagacagttaatttctataggtcaggtgatgtgtcatattgaactctaccttccaccacaatgcatggagcatgacatattttaagcacacatgtaggcctgggtggaaggtgtacaagtgaggaccagggcttcctgtgtcaaacatgccaccctgttcctgggaagacggtgaaggcctggacctgggctgggttgtttggtgctgtcacctccccgagcaacccattcatgctgcccctcacaatctagcagctctgtcttgggcttcccagaccatggacttctttcgaataagctttctcttgctgccatgaaaccagatggatgtctagctggagacaggacctgagctggaagacctaggaagacaagcccgggtttcttccatcaggggagaaggaagcagagggtatgggatggaggaagcaggaagagtgtggggttaatgggcaccctcccgggatgtatcaggtgtcctgtgactgcgaaggtcatgggtcttcagcacaccctcatcttcttcctatatatgttctgagagatgcactgatctcaccagacatcatcaaggaagctttacccaaacaggtttattctcctctgtgattacatgaagataggacacctcagctgctcaattagaaaagacccagtatcattttgtagcaggtgaccaaagagaaaagaacatctttccaggataaactaactccaaatttattttcatttcctccctatatttcttttcttttcttttctttttttttgagacggagtctcgctctgtcacccaggctggagtgcagtggcgtgatctcggctcactgccagctctgcctcccaggttcacgccattctcctgcctcagcctcccgagtagctgggactacaggtgcccgccaccacgctgtactaattttttgtatttttagtagagacggggtttcaccatattagccaggatggactcgatctcctgacctggtgatccgcctgcctcggcctcccaaagtgctgggattacaggcgtgagccatggcccctggtcctcctccctatatttcttagtgcagaagta

SEQ ID NO: 278 - DNA, 223007 bp, Homo sapiens
tatctttgcttagatccatttcctccttctttacttagttcacatattagaggcgtcctgggtagaccaatcccttaaacacacaacaaaagtttgcttctgaaccgccttctaattttttagaattttctcttaccttgtgtacttgcctcactcctcatatctgctggtcactgctgtttctcttgtctttaccttctgctttcttccctgaccacaactctctttctggttgtgttgccacaacctccctgaataatttgcctcatcaacactgactcatccctggaaacatctacactgttgtaggccccaaggacagcgaggttgctgcttaggcccccacagcttttctactgcacaactccagggctgccacatgtagacggtgctgtgaatgggcccaaccattatgccatagaacaggtctattaggctgccccttgccaggtccatttcagtcccatgacaaagacccagaaaagtcatagtagagagcctagagtgatgatgcaatccaaagccattcctctaatgacaacaatgcctgggaggaaccttgaatgcttatctgggagatgagaagtctgaaggagagctaagaaatttttagtgtgtggaagggtataagtaggaccagtgagtggacagaggctacaaagagtcatgcttaaaatgaaaaataatttctaatgtccattttcacgctgctgataaaaacatacccgactgggcaatttacaaaagaaagaagtttattggacttacagttccacgtggctggagaggcctcacaatcatggtggaaggtgaaaggcatgtctcacatggcagcagacaagagaatagagcttatgcaggaaaactccccattataataaccatcagatcttgtgaaacttactatcacgagaacagagaacagcatgggaaagacctgccctcatgattcaattacttcccactgggtccctctgacaacacttgggaattcaagatgagatttgggtggggacagagccaagccatatcatctaaccatctaatctgttcagaaaagcaagtggctattgtcttgatgggttttggtttctctggcctggaggtgtttcagccgaatttgggagatcacatgaaagaggggtgctgtgtacaagacgtaggaagttcgaacaggaggaggcatgccctaacaggaaaaggggtgccttaacaggaggaagggtgttctaatggggttggagagtgccctaacagggggaggggtgctctaatagaagtgccttaattagggtgctcctaataggatggagtgcctaataggagaaggggatgctctaaaaggaggagggggcctgaacaggaggaggagcctaaaaggaggaggaggtgctttaacaggaagagggggtgctctaacaggaggtgtaggtccctaacaggaggaggggatgtcctaacaggagaatggatgctgtaaatggaggaagggtatcttaacaagaggaggggtgctctaatcagagaaggaggggtgctctaatcagagaaggaggtgctctaaaaggaggagggggccttaacaggaggtggggtgacctaagaggtagaatgggtgctctaacaggaggtagagttctctaacaggaggagaggtgccccaaaaagagaaagtgatgccctaacaggcggaggggtgccctaaacaggaagagaggtgctgtaacaagaagaagggtgctgtaataggaggaggtgtgttctaacaagaaaatggggccctaaaatcaggagagatgccctaagaggaagaggggttccctaacagaaggaggggtgtcctaatagaaggaagggtgctccaacagaaggaaagttgttctaacaggaggagaggtgctctaacaggaggaaagttgctctaacagggggaggggtgccttaacagaaggaggggttgccctaagagggggggtgttataacaggaagaggagtattctaacaggaaaagggggtgccccaacaggagaatgggtgccctaacaggaggagggttgtcctaacaggaggaggggtgccctaacagtaggaggggtgccctatatagggaaaggtgccctaacaggaggagagggtgcctgtattagtccattcaaactatatcatttcacccctggccccaacaaaatctcatgtcctcacaattcaaaacacaatcatgcccttccaacagtcccccaaagtcttaactcattccagtattaactcagaagtccaagtccaaagtctcatgtgagacaaggtaagtcccttatgcctatgagcctgtaaaatcaaaagcaagttagttacttcctagatataatggggatacaggcattgggtaaatacacccattccaaatgggagaaattggccaaaagaaaagggctaaagactccacgaaaatccaaaatccaatagagcagtcattaaaacttaaagttccaaaatgatctcctttgactccatgtctcacatctgggtcacactgatgcaagaggtggcctcccacagccttgggcagctctgtccctgtggttttgcagggtacagccccccttcaggctactttcacaggctggtgttgagtgcctgtggcttttccaggtgcacaggtgcaagctgtaggtggatctaccattgtagggtctggaggaccatagccctcttctcacagctccacagggcagtgcccaggtggggactctgaccccacatttcccttccatactgccctagcagaggttctccatgagggctccacccctgcagcaaacttctgcctggacttccaggtgtttccatacatcctctgaaatctagatggggttcccaaacctcaattcttgacttctgccaagctgtcaaggcttgggaattgcaccctctgaagccacagccggagctgtatcttggccccttttagccacacttgtatcagctgggacacagggcaccaagttcctaggctgcacacagcacaggagccctgggcctggcccatgaaaccattttttcctcataggcctctgggcctgtgatgggagggtctgctgtgaaggtctctgacatggcctggagacattttcctcattgtgttggcgattaacattcagctccttattacttacacaaatttctgcagctggcttgaatttctccctagaaaatggtattttattttctattgcatcatcaggctgcaaattttccagacttttatactctgcttcctcttgaatgctttgtcacttagaaatttcttctgcaaaacaccctaaatcatctctctcaagttccaagttccacagatttctagggcaggagcaaaatgccatcagtctctttgcataggaagagtgaccttcactccagttcccaagaaattccccatctccacctgagaccacctcagcctggacttcattatccatatctctatcagcattttggtcaaggccattcaacaagtccctaggaagttccaaacatttccatatcttcctgtcttctgagccctccaagtctctaggaaggcccaaactttcccacattttctcatcttctgagccctccaaactgttccaacctctgcctattacccaattccaaagtcagttgtgatgtaggttttttctcctcctgaagtcagctagatccaggttttttgtctcaagaccaggaagaattaggcatgtggacatcagagagtgagtaataaaatttattaagcaaaaggacaaccctcagcaaaaagaggggtcctgcaagcaggttttcacctcacagttgagtgccagggcttccacataagaggtgatgaggcttcgctcctcccctgcatcaggtgcaaattcctggtggctccacctctttcctgcagtgcacatgcgtgcccccagtccactgtgggcatgcccaggcaagccccctcttgctattgcttctacatttttgggtatctttataacagtgcctcactctctgtagtaccaatttactgtaatagtccattctcaagcttctataaaggactgtccaagaatgggtaatttataatggaaagaggtttaattgactcacagttctgcatggctggggaggcctcaagaaacttacaatcatggtggaaggggaagtaaacatgtccttcttcatatgatgacaggaaggagaagtatcaagcaaaaggaggaaaagccccttataaaaccatcaggtctcatgagaactcactccctatcatgagaacagcatgagggtaaccacccccatgattaaattatctcccaccaggtccctccaatgacatgggggattgtgggaatgacaattcaagataagatttgggtgaggacacagccaaatcttatcagtgccctaacaggaggaggggtgctttaacaaaagaagggtgtcctaacaggaggaggggtgctttaacaaaagaagtgtgtcctaacaggaggagatgtgtcctaacagtaagacatgtgtcctaaaaggaggagggggtgctttaacaggagaaggcatgccctaacaggatgagggggtgctttaatgggagaaagtgtgttctaacaggaggaagggtgtcctaacaggagaaagtgtgtcctaacaggaggaggggtgccctaacaggacgaggggtgtcctaacaggaggaggggtgccctaaaaggaggaggagtgttctaacaggaaaaaggggtgccctaacagaagaatgggtgccttaacagaaggaagggtttcctaacagtggaaggagtgtcctaacaggaggagggattttctaacaggaagagtggtgctctaacaggaggagggggtgggtctaactggaggaggggtgcactagcaggaggaggggtgccctaacagaaggaggggtgccctacagggtgaaggtggtgccctaagagtagaagcggtgccctactagaaggaggggtgcctccacaggaagaggattctctaaaaaggaggagaggtgtcatgacaggaggaggggtgctctgtaacaggaggagagttgtcataaagggtgaaggtggtgccctaagaggaggaagtgtgccctaacagaaggaggggtgtcctaacatgaggaggaatgccttaccaggaggaggaatgccctaccaagatgaagggtgccctaacaggaggagtgagtactctaacagcaggagggtgtcctaacaggaggcagggtgcgttaacaggatgaggggtgccttaacaggagaagaggtgccttaacaggatgaggggttccccaacagaaggaagggtgccaaaacaggtcaagggatgccctcacatgagaaggggtgctctaacaatgccctgaaccttgggtgggagtttccattgagaatgtggaggtcccttgggcctagcctggtgatgagctgtagaagaggacgtggctgtagtaggagcagaggcactgagtctgtggctgcttcctcccgcctgtcctccaagacaggctttcagttagagaaggatttaatttcagggttgccccccaccttctctgaaacacagctgggacagctggggtacactcctggtctgactccgaagcactacccctggctatccttaactggagtcctggtgcccgctcatcccagtgccactctgagtagaacaggtaagctacggtatcatccacctacactggcacctacccctctctactggggatgaaaggctggctcagcgtttccaattcaggaaagggaatttctgtgactctggcctgtatggttaccagataactctcacttagaaaagtctggaagaaaagatgagcccatgggactgggcttcctctacctgcaaccttgctgctgccaacgagctgtggtcttgcatccctgcaaggcttcttggtgggtgtctgggactgatccgtggtaactccctatgtctgggtctgttggggctgttgctgtcctcaaggtctttcttctcaaggtttggcctgtggttattttctttcaaggtctatagagaatacattcattcactcagtgttgttgactacataccaaggctgtaggagcaggaccacacacctgtctcccagctgtatccctagctccagcagggtgcctgactcacagtaagggccttaataaatgtttgttcaagaagtagagtaagaaggaaagtgaaagaaaaaggaaagaaaaggaaaaggaaaaggaaaaaaggagagcgaggggaggggacaggaggggacgggaggggaggggaggggaggggaggggaggggaggggagacgaggcgaggccagccaaccacagcgcttcaatgaacaggaaggaggctatagccgcaaggccttccctgcagggctcctctccgccccctggtggtgattttggctttctctgtttgtgaggacagaggtgtggatgatccttttctggatccccttgagaacggagcttcatggtcctgtgacagggctggtgttctgagaggctatgaaaggaggaaccagtctccagccctcagctttttaagttcttctgtggctgagatagaggcagcaaggtttcaatggctctttgggagcagaaaaagctgtacagaggtttaagggcatagcctcagtctctccccctttcccagtctctctctccatgacgaagtgaacaaggggatcaaggctaaaatcttttggaaactgcttcctggactagcttgctggatgtatactgaagggcagggcctttggaaataatcctgcctttatgctgacaatacatgttttccataccccacttcactttgtgaatccccacaacagccgagtgagggggtggggtgctgtactcctgactgtctcactgggggtgacagggacgctcacctcctatgagaagcaaaaccaaggctcatctggagatttcctggccccacctccactctgcttgctctgtctagcctgcaccactcccttctcccaaacacagcccgtgagcccaatattctttcatccagagagcagaatccaagtcctggtctttcttttacaggtcttattctgctccaaagggggcccccaaggagggggtcagagtgaagctctgcctcgttgtttctctaggtcccatttcactggtaacagctgagcttactctgtattttgcttctctcgttgcacaacggacctgctttgggccagtccaatggaccaagtttgggcaggcaatggcagtcagccttctgtttctgtgtcttgggcatggccagcctgaagccagtcctgctttcttcggttgatgaaccaaaggtaggaaaacttcagaattgtcccagactcccaggagcactcacaggattttccttttcctcattatcatctgtccctcctggatgcctgcaggcttcttttacggaccccacctaccctcctccaacctgtgcgaagttcacagtgcttactcttttcttaaacacattcctcatgtgatttcctctccagggcatttggcctcttgaagtagggaaaaagagcctggggaaggactaaaaatcttagatctgcatctaatatttggggtttctgaggaccctggagggctggtggccttgtatccctatggggatacaacccaggcatttacatcctcatatccggtcttaatttttaaagtctgccttaggtcagttatttcaattattattattttttactctattagagttattgcctggtgggttaaaggaaatggtgggaccagaagttatagtaactttgagtgagctccaggatgagttggtgattagcctgagagctaaccatcccacgaggtcccttcctgagatatttactcctaatccatacttccaaggttcctggtctagagtagctgggttgtttattgtgattaatatatgattggattttaaattttcacagttaggttgtgtggggcccttatataaatgtattttaccccttaaggctttgtttttggaagaatgacttactcagccttggtattaactggtctaccagactgatttcagctagtgtagggcttttctgagagggcccaataatggtttgttttaggtcatagatatttgtttgcctgtgacaactgtctttggtgtcctaaagtccttcaaggtaaaacttggcaggcattaaattttacagcttgcggggtgaaagtctgagttatgttgactattagtttgattggatgttccctactttccacccctagtactgggctccattcaatactcgggtttccttttaccctttgtgttaggattaatcctaaccataaccatccccaatgacagggcccgcttatagctctcttctaggttttccttagagttagctttaagggttccttaggcgatttatacacttcccatttgcccttttcccttttacccttccttacattttttttttactggtcccttgacccaagtgtaatgagtccgccctcgttcagctgtttccatggctttttcggtggtcaggagcacttgacagggaccttcccagcttgggtggagcttgtcttccttccaagttttaatcagcaccaagtagccaggctggaagtggtgaaccgtgaactcaggggtggagtttgagtcagaagtccttttaacctaagagatgacagggtagaggatatggccagtatatgattttttaaaaattggtctttggtttccatagtaggaagctttgtagccttgtttaaatatgagagtccatacaataactcagagggggacaatcctaagtcttttcttggggttgtcctaatcccaaggagtatcattgggagacatttggtccaaagcattttagtttttaagattagtttggtaacgtgctttttgagagtttgatttattttctctacctttccagaggaggggggatgccaaggggtgtggtaatcccatctaatgtgcaaaccttccataattctccttagcacccttgagttaaagtggcttccattatcagaattaatatttttttttaccaggccaaatctgggtataatttgttttaagattattttgaccacattcctggctgtggcagttgggagggggaaggccttcacccagctggagaggtggtctactattaccagcagatactttagtctctctattttgggcatttctgtaaaatttacttgagtgctttgaaatggccttaacctaggaggtcttcttccagtagtcgtttttttttttttttttttttaactacctttttgtttattctctggcaggtcacacaaccctcacacacttgtttagcaagtgtataaatctctatacacccataattcttgtgtattgcattacacaagactttccccaatgacttcccttatgcagtatgacatcggttctctaattatggatttgcttattattactctcctgtcagggagcactcaccttccatccccagtttgagtggcccctatcttacccagctctttctcctcctctttagaaaactggggtcttaataccacattagggatatctggtattaggctacacagtctaacttctttcttcagggaggcttgcttagcagctttatctgcaagcccattctttatagcttctatagtgtttcctttctgatggtcatttacgtgaactatggctactggaagcaagaggctttttaaaacttgtttgaccagttccccatgtactaattttttcccagcgctatttattaggccccactttgtccagatctttccaaagatgtgtactactctataggcatatttggaattagtatatatagtgcatttttgaccttctaggaggtttaggacctggttaagagcatataattcacaggtttgggttgaccagttattggtttacctttttcacataaggattgtttgtttctatcaatgacagcatagccattatgtcttttgctgtgtattacttgggatgacccattcacaaacagccttgtcccatcatgtactggagtttctctaaggtctggtttaactttagtttgatagtctatgatatttaaacagttacggtttgatgcctcctcattctcgtctcctttctataagaaactggctggattcaagcaagtatctattgttaaatctattggatttatctattgttaagaccaaattattattattattattattagtagtagtagtaatatgaatttatattttaaaatctgggaattagttaaccatcttccagctttttggtttaatacattccagacctgatgtggggtgcttactaccagggccccgctgaaggtcaacttttgaatttcctctaccagcagagctgtggccgctactgcttacttgcacttttgtctctgtctcctgtcctttatggcctctctctctttctctttctttcttttatacttgttcttccttttacattatctttctccccagtctcaccatctgtgtctttgatctgtcttttcctgtctctctctcacttatttcctttttctattgctttctctgtcatcccctgtttcctttctcccttacactcagtttcttcctctttctgtctctctctggtcctctacctttgctgtttcctcccctttctctttccaatttaccttcttattttttctcttcctccctttcccagcaaacagaatatttacaattgacatcatttcagcccaagtataaaaattggtcctaaaaattgaactacctgctctgctaaatctaggggatttttttatggtggccttatttcctttttaaaattcctaacctcagtacttgttagaggcacacccacaaatccaacttcttcctgtcccatagggaagtctctaagagggtacatgttagacacctgctgtttagaaggaataggtaaattctcaaattttttaaaacattgttctaatttttttccttaaatttggataaggatttaagagagcattgggtttagctcctttatgacccccagattcctcttcctcttgccttcctgttgcctcctgatctccctgtcctctactttgtgagatgtatggggcagggggaaagcatgttaggggatgccagggatttcactgggcaaaggccctttattatgctctttttttttctttaagggggatcatgggggttaattcactaatccaacaaaaagcataacccacctcctcttgtgaggttggagttttggtatttacatagagaattaagtttggcacacccagtcctcatctgagccaaacttaggccaaaagactgaggctgattaacgggctctttgggccagataaaacagcaatatttattatcttttgcttttccttgtccctggttcgagggttatccctccaaacctgcagcattttccccaatggattatctgggggaattttagaggggggtctctttagtttcctttttcctttgtttcctaagcctagaattcttatttcccgtttttggttagtctctgtgtctgagctttttcctgtgtactcagcccccacactggaagtttcttcgacacctcaagaattgcttcgtttgtctccagctgtttcctcatgggacaattgggactctgcactcgctttgtatctaaggtacatcttagtcacacacactcaacctctgaaaatgcctaaccaccaaggcagtacttatagtccaattttcctaccttggctcatgcacaagtttgcctagttgccatggtgcctgcttttctccctgtgtcacttccactgtctcctgaataacagtctcaggtttgtcttctgcttttgtggggagccaggacacccagacagagcaggccacctaaatcaggtgggatgtatctcccctctcagctggagtcccactccatgcaggcacagagttccccatacgggttaccaggttgtgagaaagaaactcacccatccaatcccaaagaatggactcagagacccagagaacagctaaagtgaaacttttaatgatggtcttgcaagacagcttgtctgatgggcaggcacacctagcacagttacaacaagcaatttatcccctagtgcacaggtccctctcccggactcttcataggctaagtactatggggtcacaatcttcccagacatcacctatcacttgttgggttggggctttaggtgttgtcttgcagcattttgttgcagcctacaatgcattgcaatcctagtcagctcaggggctctttaagtatttgacttatgacctaagtagttgggcaggctgataagaacagacaaagtgagctattttgcaggctagtaaactttcatcttagactaaacttctttggtttgggtgagggcaactaaacagggggcaggggctacaagcagatgttggctatccaagcaggggcctagtatatcctgtgttttctgtagtttgctgacctaagacaatttaaggcactttatcttggaaatggaccactgtatacattatttccttcgtatctccagctccagtcagagctaaagtgagcttgggtgagccaggaggatcagtgggctggcccaggccatgggaacagaatacaagttaactggccacaaatttcatcagtggaccctagaccaagaacttggtcagttcagtcccccttacagtagggggcagcaaaaatccaaaatccagcagaggaatcccaggctttcctttgcgtgtgacccctagggcctggggttcctgtcctgaacccagatgccatcagtacaggacaaggggaaaggggataaaaaatgctaagcaggaggtaaaagttatgttgattgagttatttcctaaaatgagattttcttaaaccagaagagacagaaatatagacatctaatcagaaattttatctccacctcaggtgggtcagttgctcaagaaacaacattatatccattcagactaaagaagttgcttgttctttatacatttccatttagcgcatgaattttgctatcctaaaaagcctgatctccctttctccagctgaactgggaaagaccctccagttgcacacctctccagctctggtttagctcctgcttctctgcttttctccaggtcccacctttaggtctgggaagcaggcatagatgcaggttttagatgtgtctcagctggcctccacatgacacccctgatgcccaccacctttcactggctccttaacttgggtgccccactcatgcaataaggatcagctcagcacctcccctcccggaagactttctgagttccacccctccccgcctttcccttcattccccaaccagtcccatttgattcatcctgcctagcttcctagaacactttttaaaaattattattattgatttaatctcactacttattattagtctcttcaggttttccatttctttctgattgcatcttgttaggtggtatgtgtccaggaatttatccatttcctctagattttccagtttattagattatcgttgttcataccagtttctcataatcttttctatttctgtgatatcagttgtaaggtctcttttttagtttccgatttatttgggtcttgtctctctcttttttggttagtatagatagtagtttattgttttgtttaccttttaaagaacaactttttatttcatggatgctttgtattttttttagtctctattattgtttaattccactctgatctttgttatttcttttcttctactaattttgggtttggtttttcttgctttactagttttttaaggtgcataattagattgtttatttgaaatcttgctgtttttgtgatgtgggtgtttattgctataaactttccttgtatcactgcttttcccgtgtcccaagatatgctgtgttttcattttcatttgtttcaagaatgttttaaatttccatttaaatttcttcattcacccaacggtcattcagaagcatgttgtttaattttcatgtatttgtgtagtgtctaaagttcctattagatttcttgtttaattccattgtggtctgagaagatatttggtatgattttcattttttaacacttgttgagacttgtgttggtggcctaacatatagtcaatcctgaggaatgttccacgtgctgatgagaatatgtattctgtagttcttggataaatgttctgtaaatgtgtcttaagttcatttggtctagtgtccagtttaagtccaatgtttctttgttgattttctgtgtagatgatctgtctaataatgagagtggagtgctgaaattccctactattattgtattggaatctatttttttttctttagatcaaacatttgctaatgaaattgagtactccagggttgggtgcatatttaaaattcttatatcctcttgggccgggcgcggtggctcatggctgtaatcccagcactttgggaggccaaggtgggcggatcacctgaggtcaggagtttgagactagcctgaccaacatggagaaaccccatctctattaaaaatacgaaattacctgggctttgtgctgcatgcctgtaatcccagctactcaggaggctgaggccggagaatcgcttgaacccaggaggcggaggttgcggtgagccgagattgtgccattgcactccagcctgggcaacaagagcaaaactcttctcaaaaaaaaaaattcttatatcctcttgctggattaatgcctttaatcattatgtaatgaccttctttgtcttttattttttactctttttgacttaaagtcccttttatctgataaatctagctacttctgctcactttttgtttccatttgtgtgaaacatcttttttccttcatttactttcggtatatatacgtcttaacaggtaaggtgcatttcttctggcagcatgtaaagcatagttagatcatgtttgtttgtttgtttgtttccacccagtctatatatgttaagtggataatttaatttatttactttcaaggttatttttgatatgtaaagttttcttcctgtcatattgttaatcgttttctggttgttttcatatattctttgttcatttcttttcatcttcttatttgttcttggggtttgctggttttctgtggtggtaccatttgagtcttttcctcatttgtatgttgctttaccaatgagttttatacttttatgtgttttcatcatggtaactgttgtccttttgcttctgggttttaggcttcccttgagcattttctgtaaggctagtctagtggtgatgaatatcctcagcatttgcttgtctgggaaggagtttatttttatttctcctttatttatgaagggtttgtcaaagatcagatgcttgtagatgtgtgttgttatatctgaggcctctgttctgttccattggtctatatatctgcttggtaccagtaccatgctgttttggttactgtagccttgtagtatagtttgaagtcagttaatgtgatgcctccagctttgttctttttgcttaggattgtcttggctatgcgggctcttttttggttccatatgaagtttaaagtagttttttccaattctgtgaagaaagtcagtggtagattgatggggatagcattgaatctataaattacttttggcagtatggccattttcacgatattgattcttcctatccatgagcatggaatgtttttccatttgtttgtgtcctctcttatttccttgagcagtggtttgtagttctccttgaaaaggtcctttacatcccttgtaagttgtattcctgggtattttattcttttagtagtaattgtgaatgagagttcactcatgatttggagctttatttgtctgttactggtgtataggaatgcttgtgaattttgcacattgattttgtatcctgagacttttctttttttttttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccctttcctgtgtccatgtgatctcattgttcaattcccacctatgagtgagaatatgcggtgtttggttttttgttcttgcgatagtttactgagaatgatggtttccaatttcatccatgtccctacaaaggataggaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgctttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtagagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttgtattcctaggtattttattctctttgaagcaattgtgaatgggagttcacccatgatttggctctctgtttgtctgtttctgaagttacttatcagctccattcctgttctgctccctctactggctgccaggtaattaattgtcttcactgcaaatgttagctgttatttttcaaggctaccaggaagctggagagagagagatggctccagtgctaccaaattaactgttcttaccaagattcaacaatgtttcttgaataaattcttctagaattttgaaaaagttgaatctgaccatttttgtctgttttttcactacttttatggagggcagatttgttttcttctccactaaaaaataatttaaaatttaattttaattttagatgcagggggtccatgtgctggtttgttacatgggtatattgtatgatgctgaggtttgggtgtggatcctgtcatccaggtagtgagcattgtacccaacaagtagtttttcaacccatgtcagcatcctaagcgaattaatgcaggaacagaaaatcaaataacacatgttctcatttataagtgggtgctgaacattgagaacacaggaacataaagatgggaataatagacagtgggtactactgtgggagagggatggagagagggcagattgttaaaggtccttacttcatcattttcgctgatgtctcctgtagcagcttttaattttgagaactgttttctcactcttaaatttagctgtttccagagttcaatagatttcatctaaggtagatgatgatcttggggttgaacaataaaataacaaagtacacatatttatctaattaattgcataaaattttatgaaattgcaacctattttatttagtgtatgtaatagttacattttcacctaaactgttttctgaacaagttccaatttatagaaatttcatgtgatttacacaataaatggtttttagtgatgaataaaactgtatagacattcatagattactaatgaacttcagaatatcactagagttatcaaagaaataagttttccattagtctatgaacaatgaattaaaaagtgaatacagaaagcttctaacaaagggataaatataaaatgtagaacattagaaaacttactgctaaacagttttcaagtaagaaatataatgtaataataaatatatgaaaaggtaatttgctaagtgatatgctaacaagatacaaataccacatacaaataaggcatccttttatgtgtacagaaatagtatggatgacttttaaggaaagtaaccactaggtgcattctctgggtggagaggttcactatttaatgagggtagcaatcatacatgtgattagaaataacttctgacaataatgacaaaaatggctcttggagaaaacatattgaaggtttgcactttatattttacagatggaaaattatttatttatttatcaactcagatacttaaaaccctatattaaatctctttactgtgccttaatgaagtctctggcagattttatagctttctggtcactttcagggcttaaagacttcagtccagcacaatttaaaagatttctctgctctgtcagctcagacctaaaccaggtcctgggaatctgcattggcaagcagtgggtggtctgatctactttcctgcgttgtttctccttctctgtcttgttcacatggggtttgttttggatatattcctttttcccatatattggggtctcagtggatagtttggatgggtgctgcagactttataatcagtaatatctctctctgtccctccccgcaagtagtgcccactgtttattgtccccatctttaggtccctgtgttctaaatgttcagcacacataaataagaacatgtgttatttggttttctgttcctgtgttaattcgcttaggatgatggcatgagttgaaaaactacctgttgggtacaatgctcactacctgggtgacaggacctatacccaatcagggacgcctccccaaatccagggcacatggcaagctctttccagcatcccctcactgttctgtatgctggcagtcaacccagcacagctgaacatctctctttccacagcacatcaagcatccgaatgagatacaatacatcatctcactttcctgcagagacccccaatatctcagagtgattttcttatggactctttgcttggcttgaaaagtgggaaaaacaaactctccttactcacaaggggagaaaaggggaaaatgccacagctattatcccaaagatataaattccttactccaagaaacaatctatttcaaagaatgcttctagaatgtctaggccagtctatatatataggctgattagatgtgtcagtgatgatcataggactggttctgcttttttttttttcttttttttttttttttgagacagagtcttgctctgttgcccaggcaacagagttcagtggtgcgatcttggctcactgcagcctccacctcccaggttcaagcgattctcctgcctcagcctccctagtagcttggattacaggcatgcagcaccacgctcagctaatttttgtgtttttagtagaggcagggtttcactatgttggccaggccggtctcgaaatcctgacctcaaatgatccacccactttggcctctcaaagtgctggaattacaggccttagccaccccacccggccagttctgctcttttatagtatgctggaggcataccagggaactccttgttgcagaatgttggggtactgtggagagggagtgtgacagggttaatttcctggacctcaggatgcagaagcttcaaagcccatcctctgaaagctgcctagtcctcacttcccccctgaggccttggtgtaatctctatccaccctccaaagtcagctgaatccttaatgaggtgggcatgggtggggggggggtcttagtttatttccacccatctccatctttgtccccctcttcatgggtatctgtgatggtacagggcttacgtttggttcctgagggaggctactcctcttatctgttattataggctgaattgtgtcctcccaaaattcatatgttaaagtcccaagcccaggacctcagaaagtgaccatatttggagacagggtatttaaagagggagttaagttaaaatgaagtcatcaggtgtgggccctaatccaatatggctggtgtccatatatgaagagaaaattagaacacagacatgcacagagggaagaccaagtgaggacacaagcagaagatggatgtctgtaagctaaggagagaagaaacaaagcccatcaactctcgatgtaagacttctgggatccagaattgagagaaaatgaatttctgttgtttaaaccactttgtgacacttggttttggcagccttagcaaactaacacatctgtcttccaagggtttccatgtccaacattttctccaactctgctcctattatttcttatttcacagccgtgtcacacacttgtccaagtctcttgagtaaggctgtaaacccttggattagggttttagcacttctgtgcactgagggagaggtggagcatccaatttgccttacacacatgggacggtagggggcgacagaatcagaggcaggagtttagaaatggcagtaaatcctggagattttgctgggctacagtaatgaggataggcgaagagcaggaagctgctgcagaggtcacagcaaatccctttttctttcaagacctgatgggatgctgtcaatcccaagtaatcagagtcaactgtgttttcctctatgaagcatggaactctggtctgctttttatgtggtgtatctggttaacatagcaaaacttatatgtgattattatgtgtcaggtactatttaaagtgctttaataaatttctatattgtaaataatattttaatttcatactttatttttattatatcttatataaattaacacacacacatacagcctaagccaggtttgtccctataaaatatttattctattttatcacacacacacacacacacacacacacacacacacaccccaacaacccagttaattgaccttcttattgtccttattttatagaaaccaagttctttccagataaggtaagtatcttgcccaaagttgagttgggggcaaggcgcagtggctcacgtctgtaatcccagcactttgggaggccaaggcaggcagatcgcttgagcccaggagttggagaccagcctgggcaacatggtgaaaccccacctctacaaaaaatacaaaaaaatttatccaggtgtgtttgtgtgcacctatagtcccagctactagggaggctgaggctggaggttcacctgagcccagaaagtcgaggctgcagtgagtcatgactgcaccactgcactccagcctgggtgacagagtgagacattgtctcaaaagaaagtaaaaaataggcagggcgccgtggctcacggctgtaatcccagcattttgggaggctgaggcgggcggatcacgaggtcaggagatcgagaccatcttggctagtcttggagagtggtgaaaccccgtctccactaaaaatacaaaaaattagccgggcgtggtggcaggcacctgtagtcccaggtacttgggaggctggggcaggagaatgacgtgaacccgggaggtggagcttgcagtgagccgaggtcgcgccactgcactccagcctgggccacagagcgagactccatctcaaagaaaaaaaaaaagaaagtacaaaaactgagttagggctcaaacccacacactggctcccgagtctgtgctcttcacctctggctgtgtagctcccttgtgtgtgtcctgacttccatgtccagcttgtatgttcctatgtggcagggagtgtgtcttgcccattttcatgtccattcctttagtctttctttcctcactcagccttgttcttggtgtttgggagacatttgaagcttaataaatatttgctgagttattgacctctcttctcatttcacagtcaaaaacttaaggttcaaatccaaggcccccaaacatcttgactcctatagttattgcaaggactgacagggtgaggttctgtgatgtttcagtcccaaggaagcagggacctattttaatagagattccttgagttttcttttaagattccaacttcggccgggcgcggtggctcatgcctgtaaacccagcactttgggaggccaaggcgggcagatcacgaggtcaggagatcgagaccctccctgccaacatgatgaaaccccgtctctatgaaaaatacatgaaaatgggtttgatggtacatgcctgtaatcccagctcttcgggaggctgaggaaggagaattgcttgaaccagggagtcagaggttgcagtgagccaagatcacgccactgcactccagcctggcaacagagtgagactccatctcaaaaaaaaaaagaaaaacagattccgtcttcaataggtcttgtctacttcacatctctgacattatttaagctaactctatgaagtatgctgcgtcactattataaaaggaagaggttaaggagggggaaagaaacacacattgaatgacttccctgtgtcaggctccgtgctagtaagtttagatttgcagtctaatttattctcagaccaatccccaaatattaggcagtattttttccatcattacagatatagaaactgaggctgagagaggttaaataacttccctgagaccacaggccagagaatcaaaaggattttcctaccacaccaccagggggtgtctcaacaagagtgacaactcagcgagcctgagtctgggctctgggagatttaggatttgtgtttgtacttaggctgttcagaaagtgacctggggtgacttcactggacagccctgaatgaagaccaaaattcctctcaactccaagagtcctgggagagcaggtttacatccctcatccctagtttcccccttgtcatatgggacaggattgctgtcccttgagggacctctccagctggcgaagggtcttctctagctccactgagagttgcagcatctgtggttttcttaaggggctgaaattcagcagacatgggttctgggcctgctactttctagccatgtggctgaaggccagctgcatctctgttctggctctgggtctccgttctctgatctggggagaaatcgaccctgaccactgcatataccactgcccaacactccttctagggcttagtcctgaaacccgatgattataaattcattcctttatcttgagagttggtatctattgaaacacagatatattccccaggcaagggccatgcttaattgtgagtaagtttcagatggtttacagagactggattttgaatgaacaggagaaaaggaagagaccctgagggcactggccaaaggtgagatgcccagatctgggaataccaccaggggaaggtctgcctccccaagccacttcacagtgttgctgataccagaagactcagaaacagggcactggcactcatagtttttttgctgcaaccatccaattctcctctctgaacctcagtttccatatctgtccagccattgtctaccagagctggattcaactggattcagctcacagcttgactagggttttcttcccaccagacttagtaaggccattagtatggatgcagtcccatcagaggaggcagattgagctctgcctggcaacaattacctgccttgctgtccattctcctgggtggacctctgccctctctgagcatcttggctgggagttggtctgtgccttcgcttctaaccagaagttgaggagtagggctggaggtggaaacaccaaggaggagaattgttttcctgtttactacagagcagtggagagggacatggttaaccttcatgtctgaccctgagctgtgccaccctgggcatgctagtgaaataatagacatttcactattattggggaacatcctggtcctggtctgctaacaagtggaataatatctattatttatttaagcaattatctaaattgacatttgctttcctttttatctttctcatattctgacttcccaagctttgagtgagacaagcaaaaacacccaggagaggatagcacatattcacacagcactttacagcctaaggagcacttttatattcactgtttaattgaatgcccatggtatctctgggagaacagtcatggctgggtgagattctcttccagtagttccataggaacctgtttctccttttatagctctggcactaatgttaagtcttaatgtctgtcttttctaattaactctatatttcatgagatcaggggacatgtctctgctcaattctgtgttcccaaagcctagcatatagctgctgctaaaaaaaaaaatttgattcctgaatagacgaaaaaccatcattgttcccactttatagatgaggcaactgaggcctcaagaaccaaagtgactttcccaaggtcttatagctaattgatggcaaaattgggatcctttctggctcttagctgagaaggtcgacagggtggtcaagggtgtctgtgggaagtcatctgtctcctgccaggactttggagtggaaggcaactccgaagagagaaaagtgttatgtcgtctatcagcactcatcacactgccttacaagtgaatgcctgtgtgtctgcctgcctcaacccggccctgacccagagtggggacgtcctaaggacagggctgtgtttaatttccatctgtgtcatcagggtcaagcacgatgcctggtatgttatcagtacttaatatgattttgaggactgaatgatggattgatggatgaaccttccgataacagctccaaatgtcttttgtatgtgacactgtaggtgcaaggccagggtgaagctgcttgaagccaggcttggccctgagtggaggcactatgaggtgttgtcgatagtgctgggtattggccaagttctcggtactgtgagccccggagcacagggccttgggaagcctgcgagacacttccaccagatccacccgagcaggatggactcacagaggccattgtgtccagcctccccatcttccactggaggacacactgctacagaggggcaaagtgagtgcccaaacccaggcaccaccccactcgacattctggtttctgagggcctgcagaaccagctggtgagaatagggtgctcattctctagtcataagaggagtcctacaggggtcaaggcagggtcacaaagattaaccatcaggttcattcttgctttctcatgctctttggggcaggacagtgtttgccctcagtgctgtcttccaggtaggcaccaggaatgcctggaagtgtcactgacactcagctctcacctgggggtctttcctgctgtgggccttatccttctgcgccccttagaagcactgacatcacgtaaagctgtggggttatgtgagagacaacaccactcacagcttggccttaattgtcatcatcatcattatttgattatgtttatattattatgatagttattattgcactttatggatcaccacatactttgctatatgtgatctcatttgtttgggtagcatattgtgggcctccattttatagatgagaacattggggctcagagaagcaatgtggtgtgtccaaggttgcagagttaacgcggcagaactgagactcaagggcagatatctctgtctcttattcagctcactctgctcaatggattcctcttccactttaaagatacaaatggctcaccactggtccttgagtcttacacttctaatagaatgcattcccaccacccttatctcctggatcccagtgagaaacatggaacctcggtgaccctcttgagcctagtgtttctaagacaggatccttctacggtgctgagatggcttgtgggagagatacacatggaaagccccaggaaaagacagggctgaaatgaggaaatagcaaagggttccagggcccctgctatgtaccacaaaggatgcccatggactgtgaagttttctagctcaagaggctttctactcaggtaaatgagcatttgtgtccaagagtcttgggattgaggggaggtcacctctgttctgggaagctggctttagcctcatgcgtgagttgtccagatgctcacagaggctcaccctgctctctcagccagctcagtggcagctggttaaaacagtggcacgtggatcagctccctccctctatccttcccttctttcaccccctccttccctcccttcctccttcctccctcttcccaaaaatatttaatgagcatctactatgttccaaacatcttctgggttctaaggatttaataataaaccagaaacctaaagagagaaactctctctggtacatagagtttggtccagggaccaagctctataccagagaaaccctgagcacttggaatgctacaagtgggaactgacagaggttcagagggctggcctcatccaaagggcctccacagagtaaccccttgggatggcagtaactgaaccctcatgcagctgcctggggcagagggggacagcagcagaagtcaggggtcatttttcccctgaaatcttcctaaagcctgctgggcttcctgtcacttaactaggcaattagcagttgagaggacactctgtggcactgcaagactctgtccttacgttactcttccccaggctccgctcagctcagatgtggccactgaggaggcagttcagacaatggagatgggaaagacatgggaaggacatggggctcagtggctggagttctgagtgctggttctggcttctggagccagtttcatcccctggatgaggagggatgggccaaatctctgacagactcctggtgacctgtggagtctaagaataactcaagcaggacctggtgtcactcagtttatctaataagggatccagaatttccagtgcttaaaagctcctgtttgcctggcatcccagggagaccaaggcaacacactgatgagaaatgacttcattgcagtttccacctgtatcagactgagtcaaggtcagaacctgctacacagtaaccaggctggccttgtgggcctcctccttccacgacaatgacgacaagctctcagtctttcattccttcattctttactcaacaaatatttgctgaatgacatgaactctgtgctgagccttgaggatacacagtgatgaataaccccagcatctgtctccaagcacctttgagtatttatgatacacagcctctgtgatatcccccagcatcatgggggagtgcccagaccccactgtggagaggctcagaatctaacaaagaggcgatcctgttggggatcccagagagtgccaggcgccttgacagggaggcattccattacaggagccagtgttggggctgtctcagaaggtttcctggagaataggagcctgagaacatgcaggagtggaggaaaaagggtgttctaagcagagggtgcatgcaggcgcattcagggatggtaataatttgatgtggctgtagtgtccatatggtgcaggaacataaggctgggcaggtagaagctgccaaattatgaagaatctaggcaccatgtggaggaattgacttttttttttcctctgtggggaatagggagcccttgaatgttttaaataggctcagacttaccttttagaaacagaaatggtaggggtctgaggacaggagactgtaggactgggaggaggagcctgggtgcatgattagacatggaggtgaggaagagggagaaggtgggatgactctcagccttgggtcttggggacatttactggggggattaaggaggcttcagaggaggtaatgatgatgggtcctatttgcatcactgactgtaaactgtggaatgtggcttatgccatcagaggggaggcgtaaaggagaagtagttgggaggaggggggagaggtccttatgatggaggccatgacagaggtggtggggcagatgatgaatagaggggaatatgtagaggggaagagactgaattccctggagggagtaatctgcaaccctcggacagacatagccatattcccagatattggtgaaaagcctggcatacaggcagcaggaaattcttgagcatttcatcattaacctagagacttcaggcatgtgtgaaactgctccgactcctgtaatgtgactcagtcatactccgcctgtcagacacgggagcatgactgagcaggctcagagaagtcctggtacctcagggcagggagcgcccagagctgggcaggcataggtgggtgggattgggagggggtggaaagagaagccccaacctataaccataaatactagttgttaggatacgtgggtgtctttcctctttgttacaagtgagattcactttctgccctacgtttttgagttgtcaacaaaatcaccactacctgaagtagaatgtcttataggtgggaagagagaattgtatttgttgttcatttcccatccctgttcatttcttcctttccttcttctccttccccttttcccttccatctatccttccttccctcttttcttcctcactccctttctctcttccctattactgtgcttaccacagagctaaccaagcctcacgtttacaaagttaaactaaatttctttagtctttgcatggacgtagtcaattgagctttgaaatcttgatggggaagatagtatctttgggtggagggaaactttttttcccaattgtgggtgcaaggcctgcctctggagtgctaatttcagctcaataaacactgtgttttttccatacatgagccatggtttgagacaacccactggaggtgagtggctcagagaagagcaggactcacatcctcagtcccttcgggagtcaagacctaggatccctgaggaaaccagggcatcaaagctgactcctgtgtgggcctcaatgtctccttccctctgcttggctacattcagctcatgttcccaaggcatccagtattttcctagctctatgctttgggaatttaatagaaagataacacatagttcctgcttccaaggagttcaagatcttgcaggtaaatgatgtccacatatggagcaggcagtactgtgcactctgtgattaaaatactgagaagcaaattggccagtgaggctactggagaccaggtaggcggtggtggcatgtgaactgtaaatggatggagaagagagggaaggccattctgagcctcaggagtaatgggactgtgtataactcacttcctccttatgcctacagagccaagtatggtgcctggtgcttagtggaaaccacaacatctgcaaaattaaatgaaagcgtcaaatgtcacttctgatcctttcagtctatttagtacctctgtgttaatttaaacagtgtatcatctaagtaatgcatattcgttgcagaaaatcagaaaatgtaggtaagcaaaagtaaaagaaatgtgcacaatcccccacccagaagaaattgcagttaacatcttaatatggtcaatccaagcttttttcccctgattatttacctactctctctctacatatatactatacatatatataataggtggatttatatatatatactgtatatacacattatctatatacatttatatataatgtatgtatacattatctatatatacatttatatatataaatgtttagagagtcttacataaatgaatttctcatgttgcttatactactgtaacttgatgtacaccttttcctttctaatccacttagcttaacctttggtccatacccatcagagtctgcttgtattgcagttcctggggaacacctgtctctgccactggactgacagctcttagcgggcagtgctgatggcttccctatctttgcctccccactgcctagcccaggactagatccccataggtcatcaatgtaagctgggagaactgaaaacaagccctgctgaagacactccactgatgaagacaaatgggcagattaagccactgtgagggatagcccagttccccggagggaggcacatggtatacctgccactggatggaggtacccttaccccggtgtttgggtatgcctggcccctttgcagccagcctctccctgctgcctgcttcacgtcacctgtgtgcttggtctccatcctctccatctgggaaaacaaggtaccttggtgtatgtgtttccaggagcctccttggctatttttactccctctgagtcccacgccccggatatttacctgctctccaagaggaggaatcttcctttctctgtttactcactctggaggctcccatggcatcctcgcttccaggctccagctatggagatgctctccatagagaagataacactgtagctggcaaggccccaggaaacctgagcatcccacatgccagggatccacagctaggctgagcaggcctggctcggggcctggaggtgaggcttttccaggaagtgcacacacacacctgggggccccaggtagctcatgagtcagtctctgatgtccttgcttgcccccatgtctctggcactcattacttgaaggtggtggtgtgcaggaaggcaagaagaaaggtctgcagcttgcaaccagactgctagaggcccttccactcagcactttgttcacttaggacaggaagaaagcttcattttaaggccatatcgcagtatcttctctgaagaagagcatctacagactgcttttgtgcattatattctagccccctgcagattttggtctgtgcacttcttctctgacagggtgaacagaccctgggctagaggtcactgtgattcaagaagcaagcatgagatatagagtccaaagagctggatttgaaccctggtaacttctcttaacatctgtgtgaccttagacaaatttcttggcctctttgagcattgattttacctttgaataataggggtagtaaccctctcttctacaaaattgggttgttgaaaagattccagtaaaggaaggaatgcacaaacacctcataaatggtaaaatgctctccagaggttaaagaataagaagctctcgtcttcctgagaagaggtgcaagtagtatcttgaaaattcaaataagcccaaagtggtggcaagttgtccatcctactctatggaattcttcaagctccagtccaggaaataagtagctgggagctttaagtccagtggagggacccaggaatgcactggcaaccatcatgacatctctgttttcactgatgatggtgaggacaagactaataatgaccagaataagaagggctaaaaattactgagcgcttcttatgtgccaagtctaggatgaagggctttgcaggcattatctcatggagtcctcatacaacaagcatggccataagcactgttattatcctcattttatggctgaggaaacaggtccaaggggtcacatagctagcaaggggcagagctgggacaacccagacagcactttatctatctgtaagagttttctctgtcacctcttcactgagcttcccttggcctgacgacattctattagcctcagaggcattgaggatcctcttgattggttttgattgctgctgtaacaaattactgcaaatttagttgctgaaaacaacacacaggtattatcttatagttctgcaggtcagactggcataggtgtcactaggctaatatcaggctgttgacagggctgtattccttctggaggctctagggaaaaatctattttcttacctttcccagctgctagaagctgcttatattccttggcttctgtcaccttcttacattttcaaaatgcctcactccagcctctgcttctgctgataaatctcccctctctgacgttgacccttttgcctccctcttgtaaggacctttgtggttacagtgagtccacctgcataatccaggaaaatctccctatttcaagatccctgacttaatcacatcttcaaagttccttttgctgtgtacggtgatatattcacaggttctggggattgaaatgtggacatctatgcacaggaggggtgggcattattctgtacactattcagactttacatcagggcaacagtgagcagtgggaataagacaaatagaaaaattccctttccagtgttaaactccagaatcagcctgcagtgggtgagagcaacactgtgcaaaggccctcatggaggcagttcccaggccacagtccagcacagagaagcaaagggaggtcagggacaaatgttttcagggctcccaaatctgtccagggctggcggtgttcagatgacctaaggggcatgtctagttttgctcaccatcaaaacctgaggttgttatgcaacctcatgctcactgagtgctggcagattatgatgacttctttcaggagttttcctacaggaagacaatgtacctgccaacattgacactcaggtttctctttgtaagttgatgtcatcacagtctcttgtgagttaggtgcagtgaatcagtctccacaggattaatcagctcagggacatggactaaggaacttagccatgctaaggctaagagttggacttctgggctagggaacagtcatccagatagtgccatcctggggagggttcttgggggtctgccagctggcctatccctggcaatgccagacactgcctgtccaacacaggtaatcaatccctggttatttagtagaggtaatgatcacttccaattttttcatatgtgcaattcaggctgtgattccccatatttattactattttcactccaaattcaatagccatgtttaacaagcaaattatataaaataaatcttgctggaaaaaatcacagtaagaaataaaatactattcaagaggcagagtgctatgatggagagagggcagatagcaggttttgaattccatctctgctcccaactctccatgtgatccagggaaagcctttttccatctctaagtctcaggttccttttctgtcaaacaaggggcatgatctaaatcagcaattatcaatcccagtggtgcagcagagccacttgatggacgtctggagaatgtcaaagcctagatctcaccggggttgagaaccaccggctctgaatgatggccaaggtcctttccacaactattctatcatcccatgaaatgtctagaatttgttaatgaaaatctgggtttggatttgtttgaggcattcatcttgcttgctgaatagtaaattcaactgaacaaggaaatgaaaactgagcacctgctgcctacaaggcactaaattagaccccttagggattcctgcactaaagaccttaccatgtggtcagataggtgggtcgtgtgcccaaacaattataactaaaaggggatggacattgttccttttagaattcaccaaacccatgttttaaatgggtaattcctttaattttactgggattccctttccagaaattcagagcctgtgttctaccttcttgcttatacttctccacaaggagggcagagacagatccgacgccccaaccctgtggtctttatctaggcctgccctgagtgctggaatttagaagtgacacagcatcagttttcattttaaacatttattgaatgcttactatatgccgggcacttttacaagagttttaggtatgttaactcaatttaatggccccatgagataaacactacttttttgaccatttcacaggcgaggacagtgaggtggaaagctcatatcacttgttcaaagtcacaccactggtaagtggggagttgggattcaaacccagagactggatttagaactcacgctcccagccgggcacggtggctcacacttgtaatcccagcactttgggaggccgaggtgggtggatcacgaggtcaggagatcaagaccatcctggctaacacagtgaaaccccgtctctactaaaaatacaaaaagttagccgggcgtgcgtggtggcaggtgcctgtagtcccagctacttgggaggctgaggcagaagaatggcgtgtatccaggtggcagagcttgcagtgagcagagatcgatcgcaccactgcactcgagcctgggtgacagagcaagactcagtctcaaaaaaaaaaaaaaagaactcacgctcccaaccacttataaatagattctgtgcccttcatgaaatgttcttatggctaccaaaaataatgcttccaaacaacgaataacatgggaaatgttgatgttaaaatgttaagtgaaaagttagtaaagtaaactcatgtaagtactatgagaaagactatgtaaaatacaaacaaaactcaaataacaacaacaacaacaaaaccactatatatagaaaaaaatgacgggaaggaaaatagcaaaatagtaaccatattttagggatgggattataggtgattttaaaattcttcctattttttggtgtttttaaataatgagtatgctttctttataatctcattccctagtgacaagcaaatactcttaatattttgctgtaagaaaacatcgagtctaagttctgatatcataaaaattagttttggtttcaaaattggcaggtcagtaatttgaaatttagcatatattttctcatggaaataaggatagccatagtgattagttttttcttttttaaacttgcagttctaggaactgtgctaagaacttcatctgtatttctttattcagtggattaggaatgttttcagcccccttttccagtgatggttaagtaacttgccagaggttgcacaggtggagagagcaagggtgggaactgatgctggatgtccctctccagggtctgtgttataactgggctgatgcttctcactgcagcccatttcaaagagcatggagctaaggtactgcctttttctcccagtcttattttctctcactgcagctttcattgtgaatatgccatattttggccaccctttccagctaagtcaattttgataactatcctggggacccaactttccctcagaatattgtttgctgagaaaatgttttggatcccaccatgggcttttaaaacctatatactcctcctcttcacctctccatccaaagattaatcttctcctgaggtccttcccaggttggatgctcttctcttatgaatgaccagaactggtgcctcacttctggaaacctccagatgagtggagagcttttgctccaccctcagtatacacctggtctttgctgcctcacctcgagctggccaagggcaccttctttaacacgagtaaataagccattcctagacttctgcccttttaaaggcattgttagtgctgaatcggtactgtttgtgagcagttttggagcatcaaattcaggcaaggagagaagcccaaccacccacactgtcagcattagatctgcctaaaataacatcactgagatatcaaaccttccttgttctggttatggcatcatctagaaatgaaaaaaaaatcatgttagattatttgcttgggcctacaattttattttggatctctattattattctaaaaagggccatttaatttccatcttgggaattttctccttcagttcctataccaaagagaaaacagaacttctgttcattccagaggtgtagagccgtattggcccagctcagaaaatagaaggcatagcagagctgcctgtgagatagataggtgccatgtgcaattcacagagctccctcaccatcctagaggcctgcagttctcaggggatcttcctgtgggttaatacttgagatgcttatgcagggaggaactgggtccctgggatgcgaggggagggagtcacccatgcctttatgaaagatgcttctagcgtcccgcacatggtctgcacctcctgatgctaggtcaggactgaattgtataaaaggcagaagcttctgacagcacctcagtctacctgtctcctgagtgatctgctgcagtgcctgaaccaggtagagtgcttctcaggaccaggatgaactcttggtgctggtgttttgggcagaaagagcccctgggtggaggttgaggccattcttgaagaaagacaaggataaagaaggattttggaggggaaggttcttctggaaggggagggtggaaggtaggtaaaaggaatgaaggactgatgcctttctgaagttccaagttattcatttgaaaatatggagttactaggtggaaatcatttgtatcattcttgttactggtcttgggagactgggtttttaaaatctggttcatcttaggccaggagtagtggctcatgcctgtaatcccagcactttgggaggctgaggtgggcgggtcaagaggtcaggagttcgagactgaccaacatgctgaaatcccgtctctactaaaaacacaaaaattagctgggtgtggtggtgcacacctgtctgaggcaggagaatcacttgaatccgggaggtggaggttgcagtgagccgagatagcaccactgcactccagcctgagtgacagagtgagactccatcccaaataataataataatcataataataaattctggtcatcttagagataaaatcttgtgaaattatagttcaattttaagggcaaggaagtgaccttgggcttgtattgtctttcagctttattcagcttctacagagatgtcctgccagcagagccagcagcagtgccagcctcctcccaaatgtacccctaaatgccctcccaagtgtactcctaagtgtcctcccaagtgtcccccaaaatgccctccccagtgttcagccccatgcccacctccagtctcttcctgctgtggttccagctctgggggctgctgcagctctgagggtggtggctgctgcctgagccaccacaggccccgccagtccctccgacgccgacctcagagttccagctgctgtggcagtggcagtggccagcagtctgggggctccagctgctgccacagctctgggggctctggctgctgccacagctctggaggctgctgctgacctgggccatgaggagcacggaggagaaggactggcagatcccaggtgctgaagatgtgtgtcagcctgaggcttcttttctctcatttcccatggaaggacttcggaaatgccttaagttcccctctttatcctgcccatgttcactccattgtagggttgaagtctagcttgtgatattttctggcctggctttccctctcagacatagctctttggagaactaggtgttgtaattcagttatgaagctattttctctgtaacaataaagctttttattcctgatatcactgcctcctgatttcattgtttgcctctcccactccctacctgctgcatcaagccatcttcccttcccttctcttaaatgcaagcgaacactttacaaacttgtttaggaagcacattttggcagtgaagctacttaggcctctggaaaacaatatttccttctatgcactggattctggaactttaagcttgaaggaaagaataatgtctgagaccattacgccagacacaagattgtatgaggagagccaggaatgggtttgaagagaagaggatggttgtactcaaaaggttcaggttctgagagggtttccttcaagcatgggtcacagtttgaaaaattgcttgtccccattcatggggaataagattgcctgaagtgctcatcctgggctctaataaatggacactctttacttttctgattattataagctcaggtgtttccatcagttggctagagggagagctgggtgggcagtgagtgagttttggaggcagatatgaaacgtctgagcacattttccctgcatgctgaaatcctggatttgaatctgggtaaagaactgagaaagacacccttctttgcaaagactgtctctatgtggttgggacgtacgtgtgtgtgtgtgtgtgtgtgtgtgtgtgtgtgtgtgcagtgagaggtataagagtacaggggttttggtccctgtgttgggttttccaagcaacatttctttaggaatgggctggttccttcaggagacactcataatgtacctagaaaagataactagaaaagttaattccaaatcagcctttaatataaaagataaacaattgatgcctcctttgataagagttaatagcgataaataaagtaagctggtttatgagatcataggatgcccacagaatgagtaggcacttgcccagattatctccttatactgattcctaccaaacgttcttcattctttttttttttttttaaaagaactttgcccattttcccagaggagatcctgcctctgtcttgttatttcattacttccttctctgttctaatattgactttactttttggaatgtctcacctatactcaccaacaggtgctctaggaactggcaacctgttaatcaggctctaaatccatgttaaatgaaactggtatcttttgtgacttatctttcctcgcctagtcccttgagccactcccagctcactcgcccccaaacctgtctctcatccttaattcctgaattcttagtcttggacttctgttatagttcacattcacagttgtgggcaatttgattaagaagcagttctgaagttgactgccaaagtatcctccaattcttaaaaattagttattctgaaaacactatctatcatgaacactttggacctttggaaagaactttctttctttctttctcttttttttcttctttccctccctcccttcttcctttcccattttcttttgcactgggcagtggccctagggagaacttatcttcaaaggcagattggtggttgggggtgggataagaagcaggagtcccacaggctgactagcctttttgcaattgggccactgtcctgcacacatttttctctttgtcataccatgctgtattatggggatatggcaacctgactacattcacaacttttctggtcttatggttccttaactttgcctaggtttttcttcctgtctccagtgacagagagaaatcacccctggggttcccaaaggtgcatccccgtcatcatcttcactcactgcatcttgaagcatatggatgaaacccagcaggcttatcgcatagcttgtggtctgccctggggagccaaggaccaagagccagagagatgagaatcaagataaaaataggtgaactaccacctaccaagtagatgactacataggaatggatgtgtgggcaagtggagccgtctgtgtgtgtgtgtgtgtgtgtgtgtgtgtgtgtgtgtgtgtgtattgaagacaagggcaggggttccagacctccctgcatttgagccccatgccctctcttagcatacacacagcctcccaggtacaaacagtgccctgtttggaaagtaaacatgccatagcaatcctggcacctctgtgaagtgacttagatgcccacatgcaccacctacaatgctacctgagtgatgaatgtctctgggatgtgagtgtcagctgagcacgtctgttgggaaatgggcccctcccaagagcctgaacctgaatacttcttataaaaaggttctctggctggacgctgctcaatccactgcctagcaggtggcccattccagttggagaacgtagtgagtctttcagtggagccagggtctggtaagtctcctagcagggtctgggggagagggtgggatgagttgagggcacaggggaggagcaaacagaacacaggcagcagatagatgtggaaggggtgtcccgcaaggcacctacgcttctagtgagccaacctcttaaggtactaatgaggacataaaggcaacataggaggtggtttttgcaagggtacacagcaagtccgcagaagagctgtgactagaacccaggtctttcagctccctggatggggttatttatattggcacaactctcctttcccacatggttgtggggcatgagaggcgtaggcaagaaagaatgatcaggacatgcttctggcctgtggattatttagacccagcaggtgggaccgcctgttggacttgggtgttttctaactgatgggggtgtagtaactaggaagatacagtcgaaggtcggtaggaaagtaaaatgagggacaagaaaaaagccaagtggagattttggactggatcatacagataagttgccgcagtgtgctgtttattttccactgtggagaacttgagcagtcttcttctagtcagagaaaatggaaatgcattgattcattgcatggattgtgtcctgctctgagcatgtttaactcactggaaacacctgcttggatttgcttctttgcgtccgctctttctgggtgcttttccctccttgtcccaggccaggctgacttgtacactaagccgaatctcaaaagcccagacagagttccattggtggaaagaaaaagccggctcgcctttgaaaggctgcctttcttccaggtttgtcgtgaggagctccgcgatgtcctctcaacagagcgccgtttccgccaaaggcttttccaaggggtcgtcccagggccccgctccgtgtcccgccccggcgcccaccccggcgcccgcctcctcctcctcctgctgcggctccggcaggggctgctgcggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcggagtttgccccgtaaagcgaattgcactttgatgttcagaaacccactttgttctcagccacgcaaaactccctgaccccgatgtgatttttctccccggggattcgagagccatgcgtgggacactggaccctactgtctacacgggcttgcacacagcaggtgctcagcaaatgtctattgatttgattgtcttttgaagatgtcataataaagcttctacctcctgagaacaccttttatttgttcttcattcgtttctccacccaggtagaaaggcttgaaatgtttgtgaaaggcagaatactataattcatgcctgaacaagaaggtggctttctgatagttaattatgatagcagcgatcacatatcgactgtttcgagtattttaaggattttatgcgacaaagtccttgaatattctcaggactttatgtggcacaatctgattctcataatgacttgcgtaggagagtgcaattatacccattttacagaagagaaactgaggttaagtaatttgttcaaagtcacccagctggcgcatgataaagaagacaggacatctgattcaagggcttcattgctctgctgagttctcacctgggcttcccaagccttaccactgaggtgctcctcccgaccaccaggtccaggcagctgtgtggtaaaagtttgttttggcaactctttggggctttggaatcaagccagctgtcttctttttttttttttttagttttatgtcttattttattttttatttttggcatggaagttcattgacctactgctttgcttgctggggaggaaatttttcctaagatgagccttccaggaaactgggagctgccctctccaggtctcatttgtgcagctgaagcaggaccaacagccatgggtttctgggagtctctgtggtgcagcatgtgtgctcggaaacatggggatctcattctttagagatggtggctgtggcagtggcaatggatgggtcatcttgcataggtcagaaacctatccctgtgggcacagattttatccactcatttcaggcacgaggaaacaggagaacaatatcctctgcatggtgtctgctgggttcagaaggaagagataatcatggtaataataatagtaacactagttaccatttatttggcactatatttcaggcacaagtcaaggcactttacctatattatctcacttaatcctcacagtaatctaaaaatatagacattcacttccccactttttatacgtgagcacatgggtttagacagttccagtggtttggctgaaatcacagagctagtgaatgtccccttgagtgagggagatgagattgaaactggaacctgtgtgactccaaagtcatgccctcacactcaaagagtcatgctctactgtcttagaaatcaccaccacacagggaagagacactcgggtctctggacacacccaggctctcagaaaattgcagctcggcttcttggctgctgctcccttggtgacccaatgagtggggagctctgtcatggcatccacccagcagctggcggctgagggtgtctgctcaaaggtgaggtcggaaatgctctactgattcatccaggatgtttgaccttgcggccaaatgaccccttgccagggaggctctggagggcagtcctgctctgcctgggagtggcccttccttccatgtctgagattctgtgatttccagtgggaggtgatttgtggaagctgtttacaaacagatgatatcacccgtggacctgcctccccacactagtaatgtgtgctgaaacagcaagccctgggacttggtgggcagtgggtgggaaggaagaactgcctgactcagaacagacacactacgcagctaatctgagggtgagggctcaacctggagcaggaagctgaggcctgagctctgggaaagagaggtggtgactcacggagagatattagagtccaaataggagcacatgccctgtacaccaggcatttgggtctcatgtcaaatggctggccctgatggtggtggtacctccaggcccacatgctgctgaaacccagcaggtcagcacacatggactttgatgagagacatttgagtattttaagaatagtttcattttagaaatctagcaagcgactttggaaggtctagagctctctgctcatggtccttcaggcttttctgatttccagcagtaggtaaagctgtatgtgtggcccaggcactctctgtgaggtgatggtggtggatgctgagcctgtgggaaatttggcaaagtgaagtcctactcagaggttgtcacctggtacacgtgacaggcagaatcaggtttcgtattatctctggaataaatggacattattgttaaatatattttattcatgatggctccaatttcagcttaaattatattattatactggtaataataacaactgatacttatgtagcatttagtgtttatgaggcgtttccacatatattatctctttcataattctgtaacataagtattaccatctctgtttaacagatcagggagggactcctacagtttaaacaacccacctgaggttatccagctgatacgtgtggtctctgtctggaccaggccttctaatgccctctaagaaggccaacagccacttctgaatattcactgaaataattgaataatggcacccagttgattacttagagacagtgctgtattcactattgcatccctagtatcatgccaggtacatattaaaggtctataaataaatgattgtttattagtgcataatgtgtaaggcattgtgctaaagaattccacagagatatacaaagcatttctggacctcaaggagtttatagtctgattcagaaactatggtaaataaaaatacaagatataaatgataactcagatctgaaatgcaaaaaatgtcacaagcagaacatggcataggcaactgctctagggattcaactgagtttagatgaggcattgtgatacgactttgaatgagggcaagttactgtggactggattatttataagccttcatgggaggaaggatctgggctgggtgtgaaggatggaaacacatcagacgggcagagattcattcatttatgtatctgttcaactccatcagacactgtttatggttctgggacagaaccagaaataagaccaaggccctgctggcatggacctcaatttctggagtgaagacagacaagaaagtgagcaaggaagtcagattatttcacaccgtgaaaagtgttgtgatgaaaacaaagaaaataaaggtataaacattaactagaggtgtatggggattttagatggagctaggccaggcctctctgaagacatgttatttgagcaggagaaataggagttatgacacagagcagggaagcccatggttacagggttcctgcatccatggcagcctagggctgcaggtgtttgaggtgtgttttcagttatgttgcctccaccagacagtttcactactaggaaagtaacttggaattccagtttcttggcagacagatttgctagtgtgattgatcgtgtgccatgaggttggcattatttcattggatcctcacaactctcctacaagacaagttttccccacattttgttaagaaaactgaaagatagagctgttaggtagccatcctaggatttcccagcttgtaataggaagaacaaggttttgtactggagacattttcctctgaagtcaatgttctgaacattgtgctacagtctgcatttctgggaaagaggggagtagtctcaagcttggactaggggaggagaaaggggtctcaagggagtggtgttgatattgaaagaccctgaggacacatcttcagagaaggagataggaggccagatcatggatggtttggagtgccaaatcaaggagtttcaactatctcatatttgtggagtatggtggtaggaaaatggctttgaaagaagtacattagagagataaaagttggtttatataacatctagagtactctctgacatgaccctaagattaattaggcagcaatgattaaggtgctccagaagaggaagttaatggagagattacctctgtgagcaggtgcaatggcccaggcatgaaatgaagatctgaacctggcacatggcagtcattacaaaaaggaaatgactgttgtgaaaagcatttgtccagaaggaagagggatagaatcaggtgatgtattggggttgagaaagaggaagcaactggggtgtctctgaggttttgtgccttgtgcctgggaaatgatgacagcattgacaaaatagagaagtcaggagaaagaacaagtgtgaggaggagaggtaagtttggtccaagatgtgttgggtttgacgtgctggcaggacatgaccatgtgacagtgatgtggggctggaacttcagactcagaatccttgaacattgacataaacacaattaagataaatggtaataagccttatgcagcttggagtcaaatctttgggaatgaatgcagtcctatttctgcagtgaaggttatgagaaaatagacttggtctgtcttgttcattgcagcaacctcagtgcaaagaacagagacctaggcaagtaaaggcactcagtgaatatgtgttgagtaagtcaataaataaaacagcaagacagagtgcccaagacttgagttgagggagaaacgaagcagaaaggaggaagttgaattccgatcgaagggggcaaagatgatgaagtcagagaaattactcagatatttggcctcaacaattcatataaggttactttaaagtcttatgttctaggaatctgggcagaagggaaccagcacgatgcaagaatgcagaagctaaagaatgtcaaccagtcagggtcttccttcccactgcgcgatctatctttggcatctttaaaccattgaacagttatagtaggaaattccatctgaagggatagcagtttcatcctaactaggtagaacgggttgaacaggaaaactggcattcacattgagtaaaaaaaaaaaaatcctctcttccatggatgacactgcagcaggtcagaatgatttggccatgataaatctgaaacatattatcttggctcaggttgagtaatagtcaaccctagaaaagcaagcatctcttcttctcttataaacattgcatcagggcaagagtgaggggtattaagccatcttatttaatgatatatctcatccttaaggatttattagttccattgccaataatgtagctatatcagctctgcatgtttggaaacttaatttgcaattaagttcaaaggccatttttccatggtatgaaataggattatatgtacttgaaagtcagaaattaaccatttcccactacccaaaataattttctgttcattaattactgcaatcttccattcataaacatttattgtgtacttactatattttaggcactttgtgatacaaacaactcttctccaatagtttagtgggaaagagtcaaatatcataatactgtgtaatttgataaacgctttaagtcagcaatacagagaggtgatggctcattcggctgagggactggcaaaaggtattgtttgaagttagtccagaatgatgtgtaggaattgctctggctgagaacgtagaaaagatatttaatttaaagtagacaacagcaagtgcaaaggttggaaaggtgatcatgtattttatagaaagcaatattgcacggctgaagatcatggaagccagagtaggtgagattatatagctagtcggggaataaataaagcagggtcttgtatgactcttgaaaactcctggaaccttatcttggaggcgacgtggaccatggcatttttgtggcttgataggtctctctcttgtgtttttaattatactgaagttaccttagcttaaaaaaatgagggcattagcatcatttctagccaccatgctcacctatcttcttttcttagtgtcttccccaaatttcaaaaagtgctcttcatagttttatattttacttgaatcttccttaacctcattgaataatgcttgtcccactagccattctgcttgatcatttcatcccagtcaccatgtcatctcctaagttctgtgctcaacagtctttctttacttcccagggtcccagccctctggaaagcattgcccactcttggtcagctcctgcccctctattctggacactgcactgctgtcagtgttttataattcactgggattctcccccgtctcttctctgctagtatttctgctagttccaattctaaatctgtgcataataactaaggtttagcccttagctgtctgactttttctttctacagaaaaatctcattcattcattcatttactaattcctcacacttttattgagaacctaatatgtgctaggctcttcattaggagttcagatagaaatatgtatctgagatattgctttatgtgtctgtctctaaaatttctatctttaataatgatacttcctgaaaattaaggttaaaaacctctgattctcataaaatggttttatttcactaattcagacgcatctcacatgaaacatcactacctctcaaactagtgttgttatatttttctttagatttctctactttagaggatggggatactgtcaccaattacactaaaaactgcagtgaaatcttcgactcttccctttcttttgattttgcatctaatcatttgccaaagtgtatttctttttctttgctccctttccccctatatctactaccatcatcttttaatcctctaaaagaaaatgggcacagaacttggaagtaaaggatccaggcaaggcatttgccatgtggtaccagacgaggctcaagttggaaatcttaatctatgcctacatatggtggcaacaagctatctctgatgaggtcagaccacatatgatggacagctgcttatatttcccatgctctggagcagtataacatgttagagcactttaactataaacatatacttcttgcctttcattttatttttgtctaatattgtagtttcatcttaacaccctgaaactacttctactattttatattgtcaatgcttgtttatttttatccacattttcatatttttctctgcccccttaccattgcctactttagattattctctccttatggattcaattttcttcttcctggagtaaatccttggtagttcttttagccactattagtagcaagattaatcttcatctgaaaataccttaattgcgcccttacgcttaaataatattttagctagatatagaattccaggttggcaaatattgtctcaaatcactttgaagatattattccactattttctgacactaatggttgagaaaggtgctatcagcctttttttttctggggaggtaatctgtttcatattccgatactttttacaattttcccttcagatttgtgtttgtgagaattcatgtctttcattcatttctaaaaatttagagccaatacctcttcaaatattgctacttattcattatttcttatattccttctggaaatctcattagatgcatttaggacttttgcattctgtaatatggaaatcactgcattctaagtcatttcaacatatctctcagttcataatttctcttttcaactattttaaatatattattgtttgccacttaagtgttaatttacctcaatatctatgtaaccttcctttcacattaataaaacttctaagttttaattgggtctatgacttccaagaataaacattccaggatcccttgcagctaagcatcgccatatgactcgttctgggcaataggatgtcaatgggagtatcttcaagacacgttttcaaaagataaacccacatcctttttttcctttccttcttcattccttcctctgcttagaatgtatactgatggctggaactgcgtattgagccaaaataacaagtgtcacccactaggagttgaaatagaaatgtagaagaataatcagttccagatggctatggcgccttaatgccaatgctgaacagtcaagatctgggatttttatgtgagaaacaaattaattttatgtgagaaacttctaacttcttaatctatctttttttggcttttattctcaggcacatctaattttaacctataccatttatttattgattttcaaatgacaatgaatatacttttaatttcttatggttctatttggttctttttttatagagtcgatatattttcttatgtcttaaattcttatttgtgtttaatcattttaaacatacttttaaagatttaattttttagagcagttttaggtttacagcaaaattgagaggaaggcatggaaatctcccatacaccttctgccccaagatatgcatagactccttgatcaccaatatcccccaccagagtggtacatttgttacaattgccgagcctacactgatacttcataatcacccaaatttacaatatttatctgataattcttttatctgaaatttcttggtggtctaattctactgcttatagtattcattgattctccctgaagatgaaatcacaattcaaaattagaaaacatacaagaaaacaagccacaagagttcatcttcagtgagactttatgtgtgggcatcctaaggggattatgttgaagacaaatccctctagattgattttgaatttatttctgccaggtatctcaggtatctgtcatctgcctggaaccaatttttatgtaattatctagtttaggtattctcagatcccatgtgtagtgtcctttggaaagagtggcaaatatatatgaggcacagacccttggttatacattttaagggcttattttctcccctccttataaacccaagctaaggcagacaagcttctttgtgtcttgtggtgttgcttctgtaatccaccttttccagtgaggatgtttcctttattgctcccaatcttgtctccttctcttcaagacctgagattccaaaaccttagaaaataacattttctactttcagacagctgccacatcaacctatgggccttttattttggttttggttctcaattctctattcaattatggaacttgggaatttttttaactttcatgcaagtttagatacacattaaaaatatatttattacattgtatctaacacatgagatggtaatagtataaagatttaaaagttttctaataagcaatactgtcagaattggtgttagttcttagaaagttccagatgatcacagctgtgctaaggaaaacgaagggaaaacatttctgctattcttaggggcaagtatgccctggagactgctgaatcagtgatatttgatgtgagagaaccttaaaaaaaaggcaaaatccaggagcaggttgttgattctcagcccattgctaaatatggcaaattttgtcatacaactgctggactctatgctccttgaggacagtgtcatgtcccatacatcttactatttctctgtctacttggcactgcagtttgtatatggaagttgctcaacacaactgatgattgattgttgacagtacaaatccttgctttgaactttgtactcatcagaaaattacatcaaggtgtggtgcatttcagtgtaaagtaccatattaactgtgcactccacccagtgtagaaacatacaaaaaaatgccagggctcatttttgacattatttccattccataactaatattatagtcaataataaagtagagatgattgatgtattcctgcttagttcaaaatagattctaaaaaacttttcagggtaaacagtcgaaagttcacgacatatttataatttgagaaggttattagagactatgtagtcagatcactcattaaatgcagaaaaatgtccttctgtaataacctgattagtgctaaacacagctagatacaggatgttagctcactgcctcacataatcatttatctcattttgaaaaatttaatcttttcaataaatttattgcacttctagaaaactttacttaaaaaatctttgtattaggtttttgattttaaaatatacttttctcttattattgaataattctagaatgttcagggcataacatttttatatattcaggaaagagactatgatgacctccattatagaggaaggagcactgccctgtttaaacccagggcatataaaactgaattgtagagaaatacaaatatacataaacaaaaaaataaaacaacttataattctattgtctacagataatcatttttacacctaattgtgcattcctccagatctttatgcaaacttttttttcttttaacaaaattgtcttcaggttttgaacgctattttttcatctgaacttgtcacccaattatgtatcatagcatctttgcatgacaatacacattcatccatagcaaactttttatgccttaatcattttctattttatggatagtccactatttatttaagcaactccttattgttgggcattgtcttgcctccaattctttactataattaaatatgctgtaatgcatttattcattcagcaaatatttgtcaggcaccttaactctgcctgcaccattcagcatgggaaacgaagttcctgtcttcagtgttaacttctgaagggggagatggagattgaaaataaacaaataatcagagcacaaatatcagataatcacaaagagtgataattgccatgaaaaaaataagatgggttaatgagatagtgacaaggctcagtctgtaatttaggaggggaaataacgttgtgtcacatatccataggataaaccttagatgaacctgtagaattggaattgctgcattttctattaagctatcctcccactgtggtggagaaggcctgcttcttggagtgcttaccaacactgtcttgcaccttgctcccactctgggccctagtcctgccctctgcaccacctcagcaccatttcttctctatttgcctcataaaaatattgtccctcacatgtataggactttatactttacaaacaagtttcacatgctaacttaatgcattaattattttgtttctatattttattacgtaaatgttcaaatctgcaccaaaagagagggtaggataatgatccctcaattcctcagcacccagatgaaaaagaaatcagcattgttcccatattgtttcatttgttctctggccccctattctttttttctggactattttaaagcaaagcccacatataacattttcccccacccactaatactggagtacatgtctgtaattgacatagacatttttctttcttgcatatcttcaatgccattaccatttctttttttgtttgttaaacttttaggttcaggggtacatgtgccggtttgttatataagtaaactcatgtcatgggggtttgttgtgcagattatttttcacccaggtactaagcctagtacccaatagttactttttctgctcctttccttcctcccaccctcggccctcaagtaggccccaatgttggttggtcccttctttgtgtccatgagttctcatcgtttagctcccacttataagtgagaacatgtggaatttggttttctgttcctgcattagtttgctgaggataatggccaccagctccatccatgttctgtaaaagacataatctcattcttttttatggctgcatagtattccatggtgtacatgtaccacattttctttatccagtctatcattgatgggcatttaggttgattccatgtctttgctattgtgaatagtgctgcaatgaatatgtgtgcatgtgtctttatcatagaattacatatattcttctgggtacttacccagtaatggcaaatggcagttccgattttaggtctttgagtaatcatcacattattttccacaatggttgaactaatttacatgcccaccaagggtatataagtattcccttttctctgcagccttaccagcatctgttatggttttgactttttaatgatagccattctgtctggtgtaagatggtatctcattgcggttttgcatttctccaatgatcagtgatactgaactttctttcatatgcttgttggccacatgtatgtcttcttttgaaaagtgtctgttcatgtcctttgcccactttttaatggggtgtttgcttttttcttgtaaatttatttaagttccttatagatgctggattttagacctttgtcaggtggacagtttgcaaatattctctcccattctgtaggttatctgtttactctgttgatagtttcttttgctatgcagaagctctttagtttaatcagatcccatttatcaatttttgcttttgttgaaattgcttttggcatcatgaaatctttgcctgtttctacgtcctgaatggtattgcctaggttgtcttctggggtttttatagtttagggttttacatttaaatctttaatccatcttgaattgagttttgtatatggtgagaggaaggggtcccattttaatcttttgcatatgggtaaccgtttactgaatagagagtcctttccccattgcttgtttttgtcagctttgtcaaagatcagatgatcataggtttgtggccttatttcttggctccctattctgtttcattggtctatgtgtctgtttttgtaccagtactgtgctgttttggttactgtagccctgtagtgtagtttgaagtcaggtaacatgatgcctccagctttgttctttttgcttaggcttgctttggctatttgggctccatatgaattttaaaatagttctttctggttctgtgaaaaatgccattggtagtttgataggaatagcattgaatctgtaaatttctttgggaagtatggacattctaatgacattgattctttctatccatgagcatggaatttttttttaatttgtttgtgtaacctctgatttctctgagaagtgttttgtaactcttcttgtagagctctttcacctccgtggttagctgtattcctagatattttactctttgtgtggtagttgtgaatgggattgtgttcctgatttggctcttggcttgactgttgttggtgtatagtagtgctagtgatttttgtacattgattttgtatcctgaaactttgctgacattgtttatcagctgaaggagcttttgagccaagaccatgggattttccagatatggaatcacgtaatctgtaaacagggatagtttgacttcctctcttcctattttgatgccccttatttctttatcttccctgattgctctggccaggacttcacatactgtgttgaatagggatggtgagagagggcatccttgacttgtgccacttttaaggggagtgcttccatcttttcccaattcagtatgatgttggctatgagtttgtcatagatgggtcttgttattttgacatatgttccttccatatctagtttattgagagtttttaacatgaaggaatgttgcactttatcaaaagcctttgctacatttattgagataatcatgtgttttttgcctttagttctgtttatgtgatgaatcacatttattgttttgtgtatgttgaaccaaccttgcatcctagggatgaagcctgcttgatcatggtggattagctttttgatgtgctgctggattcagtttgcaaatgttttgttgatttttgcatcaattttcatcaaggattttggcctgcagttttctttttttgttgtgtctctggcaggttttggcatcaggatgatgctagcctcatagaatgagttgggaggaatccctcctccttgaatttttgcgaatagttttagtaaaagtagcactagttcttatttttacatctggtagaattcagctgtgaatctatctggtcctgggcttttttgattggcatgctatttgttactggttcaatttttgagctcaatattggtctgcttagggcatcaatttctttcttcaattcagtcttgagagtgtgtgtgtccaggagtttacccatctcatctaggctttctagttcatgtgcacagaggtgttcatagtagtttccagtggttatttttatttctttggggtcagtggtaacatcccctttgtcatttctaattgtgtttacttggctccctctcttttcttctttattaatctagttagtggcctatttatcttattaactttttcaaaaaaccacctcctggatttgttgatcttttgaatggcttttcatgtcttgatttccttcagttcagctctgattttggtaatgtcttgtcttctgctagctttgggttggtttgctcctgcttctctaattctttcagttgtgacgttaggttgttcatttgagatctttttaactttttgatgtgggcatttagtgctcttaatttccctgttaacactgccttcattatgttccaggggttctggtatgttgtaactttgttttcattaatttcaaagatcttcttgatttctgccttaatttcattatttactcaaaagtcattcaggagcacgttgtttaatttccatgtaattgcatggttttgagagtttttttagtcttctatttttaatgcgctgtggtctgagagtgtgtttggtataatttcaattatatgatcagctttagagtatgtaccatgtggcaatgaaaaaaatgtatattctgttgttttgtggtggagagttctgtagaggtctattatatctatttggtgcaattttgagttcagatcctgaatatcttcattaattttcttcctcggttatccatctaataatgtcagtggagtgttgaagtctcccactattattttgtgggagtctaagtctctttgtaggtctctaagagcttgctttatgaatctgggtgctcctgtgttgggtgcatatatatttaggacagttaggtcttcttgttgaattgaaccctttaccgttatgcaatgcccttgtcttttttcatctttgttggtttacagtctcttttgtctgaaattaggattgcaacttctgcttgttatgatttccatttgcttcgtaaatttcctccatccctttattttgagcctagggatgtcattacatgtgagacgagtctctaaagacagcattccattgagtcttgcttttttattcagcttgctattctgtgccttttaagtggagcatttagcaaatttatattcaaggttagtattgatatgtgtagatttgatcctgtcattgtcttgttagttggttattacgctggcttgttgtgtggttgctttatagtgttactcatctgtgtatttaaatgtgcattaccatttctaaccgacctaacagtacttctttaatatcacataacacatagttcttgtttacatttccacaattatctcaaaaatgcagcttttgttggggcgatcagacccaacaccaggtcgtgggggtgatgaagtccggcggagtcaaaggaattagaaaaagacagtttgagagggaaagtgggaccagggggccattgcaagtgtagaggctgcgaaggccctgagctctgggagcccatacaatttattggtgttcaaacaaaaaaacaggtggtgaggatgggggttgaaatgaaacagtgtatcaagtgaataagaaacatatggctgcttgagataacggcagtgctagaaacaaggagccagcaagtctggcagacatgctagccctgcctcagcttctctcccaacactcagctttactcccaacagctttcaagttgatttctttgagttaggatgcaaacgaaatccacacatttagttggtttgtctcttaagtttcttctaatctgtagcaacccctgtactctttcacatcatttactttttaaataaataggttgtgcatcctgaaaaatttctcacattttgagtttggctgattgcttctttcttgtgtcacttgactttcttgttatgtttctatattccccagtatttcttataaattggcaattagatttagaagcttaaactaaattcaagttcaattttttttgtgataagcataaatcggatgtgatgtgcacttcttattataccatagaggaggcacatactgtctaggacttctaagtttagtgatgttaagattcaactgcagatttaggtgtcagcaccatccatttatccattttaaggttctccacaatcctttcacccaatgatataagcacctcttggttattgtttctagacccacttttttttcattatgggttaataaacagtaactttctctccctcgtcttcatttattaactggattttttaataaaaaataactttcctcatcaattatctggtaatccaaattacagttttataggaaatatagagtaaatgcaaaactcctcctcttgccagttttcagaataataagttggtggcccaacaatttccaaagataactctttttatttttttaaaatagtatcattatagattcatgggtttctctttttctttaatgcatcttgatcaattgcaatgattatttctctcattttttagacactgggagttctttaaaattgcctcctgtgtttttttttttttgacacaacccccagagtctaccatagtttgcttgctttctggtacaataagatatcctgggctaattctgtatattacctgcctcagatctagacccaggtatttctccagtggtttcttgccttttttttttattttttttttttagtggtaaatggtatgtagagaccttactctagacactatggagacaaaatgtgactgcgtttttattgttgcgagattttttttgtgagcagttagaaaacacattttaaaagaatgaattaataaccaattcaaatttaacatttcagaataagcacttaacctctttggttctatacttgcatttttttttcttatgctgaaaattttgttttctctttgttttatcctacaatatggctatgttttcttccaagtgataatgcgaacattattattatcagtaagatcattcaatgctatttacattttctttgagactcatttgtccttggaatagaaatgtggagtaaaaatgtgctttagaattacttgcagtaattcttttctgtatatagttatgccaccaaccctgatatgcatttggacttattttggtttgtttttactgtttgtagatttttatttaataattttgtttttaattatgtatataacatttacattaatccaaagtcaaaactatcaaacaagatgtattcaacaaagtctagcttacatctttgtcccccttcttcctcccttctgttccataagtaatcatttgtattagtttttatgtttagcccacattttctttaaggcattatctcttaactgtattttttaacacttttatgtaggcaagagggatgatgcttacctacatcataaaggaagtagcactgtcctatttaaacccccgccccaggaatccaaatcctgtgctccttcctctgtcccatgctgccctctacagacacctcggggaatttcaaggagaggcagctgtcagttcttcctgaggttagatgtccaaattaagcagactctttgtgcttcagtgatactaccttctactctagaattttgtaaaaatacgtatgcgaacctttttggggctccaggcagtgcttggtgtccaggcgaaaatgtgtgaataagcaagcactcgtgtgtgttgggaaaacaaattatccctaaatgctgtcattttctcttaacaccagctgcgatgatgtggaattgaggtacaattaaaacccatgaaatgttctgcaagtttaaaatgaccataggtttaaatattttttttttctatctaattcaatgtaattttaaattgtcttgacaactaggcagaaaatagaaactacaactttcctaaagaaaattcctggccgggtgcagtggctcacgcctgtaatcccagcactttgggaggctgaggcaggcggatcacctgaagtcaggagtttgagaccagcctggccaacatggcgaaaccccgtctctactgaagtacacaaagtagccggcgtggtggctggtgcctgtaatcccagctactcaggaagttgaggcaggagaattgcttgaacccgggaggcggaggttgcagtgagccgagactgggccactgcactccagcctgggcgacaagagactctgtctcaaaaaaaaaaaaaaaaaaaaaaaaaaaaagaaaaaaaagaaagaaaattcctaactgggcgagtgcataagtaagacagagttaaaatcctacggtactgggtattgtttactcccaaagggtttcttccaagtcttctccgctcccgtcgggcctcctgccggggcggcaggagcaaaggtggcgccgttctgtacacagacatgttctagcgttctagcgtccccagtctcttccctcttcgttctgctccctgaggcacctagaagcaaaagaaggttttgttgttgttgttttgtttttgtttgttttgttttttgagaaaggggcgcgaagcagggtgcgaatggatccctaaattcaggtcgtggctggctttcccagcatccagtttctgcttagcaaagatccaagagagcttccccgtaacttttggatttttgtctgagataagggttcaaaagcagagcattttaatgtcatagatagttcagatggatacattagaattaagttatttgaaaaacaaacaaatgatacaggagctataaagaaattatttaggcagttagtgagtgtaagagagtcctccgtaaggcttcccttttaacaaaaagcagcctccaaataatttcttttccagcaaagaacagcttgtaaaactgagctgcagacctaaacaagcaagctggaagcttgcatagttagatgctgttagctgtgctgatagaaaaaaggctacctgggggccaggcatgttcaacatggaggatccctcttctcttttctttgtcgccacttgggcagtaaaaaggcaggcaacatggtccggactggtagagaccccatctgcataataaaatattagcgggggatggccagcttcttcacactctatacaaacagcacacctggtccgagcaatctctcaggccgtatgttaatcagacactgcctcctcaagcttgtctataaaaccctgtgcgtttcaccaggaaacccgaagacccacttgggcacccgtctctctctgcaggagacagagctattctcttttctctttctttcacctattaaacctccactcttaaactcacttcttgtgtgtccgcatcctcgatttccctagcatgagacaatgaacctctggtatttaccctagactatgaggcctcttcacaaacaaacaaacagaaaaaccaataacaacagtaaaagtgctaaaatgccagtaggaagtggtgaaagcggtgctgcaagtgggtggggaccagaaacatcaactttgagatgagggcaggcagggtagctttaatttgttcccagtggagcaggcccctccaggaggagctgccaccggtttggggagcccacaggtcctcctcccaggtctggggcaggacccaggcaggttgcgcacctgagcgacggcccttgtcctcttattttctgggtaaggggctgcccttttcccgcacaacagtggtcaggagaggcagtcactgacttgaggtgaccagggaagagcagggccatccgtttcttcggaaaaaaaaaatcagagttttaaaatcagagacatgcccagggctgaagcctgaagctgtttcttcctctgtgccagataacctcaggatccataattctttggaatctcaccctgccgaattactttctttcaaaaataaaattattttctgataattacggtaatgtacattccctaaatttttgaaaaccatggaaacatgaaaaaggtgtgtgtgtacacacaatggagacacactttacattctgtaaatgctgctttttcacatcacatgatgacagtttgtccacttttaaaagtggttgtaatgactgaacaatattttacccattttagggatgcacagttctttagttaactattcccttcgtgttgaacattaaggcagttctacttcattgctcctgtaaagaatgctccttcacagaataccctgggtctcagcttccacactggaggagaggaagttgctgggaacatcagactgggacaggtcacccatcctttgtttcttccagtattgctcctctgcaaaccttagggccaccatcagcagcagcctccaaaccagtattgtggggtagggtggtcactacataaggatatctggcctatggggaaagtggggactgtaatccagcttgaatgttgctggcctacctgtgtgtaagcataagtctgtgtccattcttctaattcactcaaaggtgccacatggattagacgaacgagtggtcctggtagcaactggggcctgagggggtgcatacatagaaatggaatactacgatgtcgttttgattttttagttttattttaggaatatcctggcttagatttggctatgatttgtgctttactctcatttcaacactttaccatcagtgggaaatatcactgttgctttatgtgcaaagtgatggttttaataaggggtaaagaggcatagttagttgaccactgcactttcatctgggacagcacctttcttacccaaacaggatcatattgaagctatgacttacatggtttgggatcttagttgtatacatttcaaaaagcgatgttaaacacattgagctaggctgaaaaaagtaatttagaaagaattttacttcctggttcgaagtaaatcagtatagcatggtggttgtgttcatggtctctgcatccagactgctgtatgaccttggcaagtgaaggcaacatgtgatgattatgtttccataactgtaacatgaaagactaagagtacctaccccaaagggttgttgggaagattaattgagaaactgtaggtaagacacgtagaacaatgcctggctcatcataagtgctaagtaaatgttagattttatgattatatccatttataaaaccagcagcatttctcatttccacttttttcttctttccagtcttcttacataagatacttgttcatagaatcccagtctcatttttctccctgcatccacaacctcttcatgtttaactctccctaaggcactccagatatttactgaaaaaattgagttaatagttattcctgggttcttcctttcccaccctggtctctcagcaacttttcttctagtttttggattctttgcctccccattctctgtcttataggtggggatcctggaatatctttcataacctgatggtagcagttgccttcaaccagagcctgggcactacattacaggggaaaatcaggcctcattgctgtggctatgaactggtacccctcctcttcctgccccaacgtaatcgtcctacaggccccttcagagatgttagaacttctacttttctggtctggagttgagctctgtttcttgtgccaggcagtgctggctggagtagcagaggggaggagacactcacagagcagcctgggctgtagcaaaggcagagagtaccacgtggtgctgataaaacaaaggctttattttttcatagggtcagacacaggtgatgacaactggctgtgcagatattgcacacactggcagataccagggttgatatcctgtgggatcctggagaatggacaggaagagccactagggatacctcagagctctctgcgggggaacttctcagtgctgaccaaaggaaaggagatttgagtatgagagagcaaagcagaccaggatgctccttggactttctttcctctaaagttgcttatttcagcataaagatccaggtcagtggcagcctgagcccccaccttgctgaccactgcccctgccacagaagttggagctgtggcacttgcattggcgggacctgtggcacctgtggtggctcagggagcacagacactttgtgtcccctcaaagtgctcctgtcactcactctcctcctcctgagatcaggtgtccacagtcctcacacacacaggatttgtctgtgatgtcccctcaaagaggggacacaaagtgttggaaaacacagtgctattttccccagttttgctggtgatggaggccaagagaatgtcagctgggcagaaagtcagtctaatgaagctgtgtcattgtggggctctgggccttctaaagggtccacctcagtccctagtccatggctgtagatggagacaccaccttctgtgtttctttatcatttggcttcagcctcctccccttcctaatggccagcaccagccctcctcactccatgaaattcctcctacttcaagtccttcattcccatattccttcattaataaatttctattgagacttagcaatgtttcccatccaaagagcaccagaaaagtaactatagtagaatgactttatgtttgttgacttgttgcaatgatggagataggacatgatatggaagcattaagaggtgctcactgtaggatttgggcttgtgtgttaggtagtttgggggagtgttgacggaattaaagtttgttctggatttgatgctgtcagaaagcaaggacacttcaataagcaggtatcttaatttttaactaggaagttggagcaatgaggcaaggttaaagctataactagtaaaaaggtagaagtcattcatatgagctgagacaagtgaatgtttggtcatttttgtggtttgggcaatgcttttgcttcattgatgctcagagtggtcttgtttttgtcttgctccctcgaggtcacagagttagcttatctaaggttagagttctgtaaaagtatttatattcaacaggagaacatcagatccttgctactagagcgaggccagcttgctgccagaaatctgggctactccttcttttctcagcatcaattatgggccaggcatcatggtcagtagtagtgatagggtaggtaagagaaaatcatggcatctgtcttcaatgagcttaaagtctagcagatctaacaaacataaaagagtaaattgttagggataatggaccccagaaggagttccatgtgctatgggcatgtagagaaaaggtattgaagtctatactttgttgcaaactgaatatttattttttcatatcttgcagttatcataagcaagccttatcctccagacagggcaaacatggcagccattttcctccatggcagccattttcctccatagattgcaaccctgagccgttggcagcaggggaggcaagaggtaggagccagaattaaaaaggaaaataaatcacacattttgggcaagtttcaaagaatcaaaatatcttttccaatgactttcagtacatcgtgttacctctgttttatgaaacacagtggatgactattaggctttcttccagccccattcttgactacctgtcttgaaagcctccccacaagacctggagagctcattaatctcctttctaccttagtgattgcccttgtcactcactctcctcctcctgagatcaggagtccacagtcctcatatgcacaggatttgtcctgtgatgacacatggtagctataagaccatgatctggtcacttcccttacagcacaagggcacctccctgagagtcactagtcccaggagccccatcctgaggagacttggcttcctgtggtccccagatatcaaggaaatacagagactgctctggctggatgaatccaggaaaaatttcatgacttagtcattccaattggtactataggaacaggcactgcaggacctcaggtttagctctttggagtacattttggacattccacatcagcaatcaaagatgagtaaacaaacagaattcttctccctttgcttacaactcacagttccttctccattctgttcctgccatgactgtgacagtcacattccatggcaagcagctgagtcattcttaaggaaaatgggactcggtagccagaaagtgccatataccttcaatgtgcctaagtttcttatatggattctaattttcccctcaggttaagtagtattttgagctatttatacctctttagtctcctgagaaagttctggttggacccagtgtgtaaaagaatgttggactcgaatttttttcttgtgttgggatgttggctggagttgaaagataaaaataatatgtgccccttatccccttatactaaagtaacctcaggataagctgctgaaaatctctgcaggacttgctaagaaaaaacataactctatttctctggtccagttatatatctggaagtttgagttttgataaaaattttttaggtaggagagttattgtcctagaagacagtactatggtttcacccttatcttgtataggaagggaactggttgctctcttgtaacagagatcaatggaaaggggaggactcatgattcgaaattgtagatgttagaggtcccttcaaaaaaggaagacaggattttcatccagcagcagaagttctgctgcagtagtagatttgattgtttaacttctgagcctattgtttaataaagaaaaggaattaaagagatagagcaggatgttgagacataatagtagacaacatctgggaaggaagaccagcttgcacattcttcctagtgttgtgtttagaacggttttctgttgagcagtgagacctcatcatcaagaagctgtggctggtgtcaatgaaggtgggaacttaaggagtatctgaagggttaaatctgactgctcatcccatgtctgggagtagcgctgtggggagaacccttgcagatgctccagaaggactcacaaaaacaccctataagacagccctcctgcagagcctgccacacacagggagcaagcaaccaacagaggaggctagtggtacagtcacatgtgtaatgatttcccctccccttttccatctcccaatacaatggaggaggaagtgttattcaggaagaaggtggagaggtggtagtgaatgagacaaagagccatacatgttccctcccaactccagtctcttgggagagccatgggcagtgctcactgggaagggtgaatttgagtttgaagatgcgtaccgaattaaattcagctggtctggactttaatatccataaaattcactccagaaatgtggaatttccctgagatattttcaggagagattcaacacagcataggagaagataatgatgggataagacaatgcttcttgtttttatgagaccaagtttataaggtttaatatactatttttaaggttctaacaatgtctttataacaagggatcatctttgggattctccaccttttctaacatcaatgaaatcaataaatgccaagattccatgtcacaaaggacaaaaaaaagcaggttcagggatgttggttgagggcttcaaaatgaccacatgtgggtaatgcaaaggcaataggaagtagaaactgggaagttcttgagggtgggagacatgttgggattttgggggccagataggaagtcttctagggagaggaatatcttaggtcaagaggtggaggagaggaagttgggtgctggatggtgagaatactgtgtgctactcacctgtagtccatggggagaaagaataaaggaaaacttttggggagtcagtagaagaccctgatcaatctgacccttgccaagttccttttattcaacatctgccatcttcttccccaattcttggctacaattcttttcttgtaccatgttttctcccaacattctgtctatcctgaatgtaaggagaggagtgaatgtactgagacataaaagatctgtgctagatcccaggcaggtgtatcacgttagtgactgatacttggtactcaagaaataaactttggctctgacagagttctcctctccagggggcatggaataggtttatttattgtggaatggatagatgcagggtagttggaagagaaaataaatgggagcattgaaagaacccaagaacatttgacagaatctggagtgggcaccacaatattgtgttggctggcattacacctgggcaatctgctgagtcagagtctttctggaaattaggccaaagatggggttattaataccagcacacactgagtgctggaatccagatatttatcaatgcaagtttttatttaaagattaggatttatggtttatatgtgatttccaacttaaatggtaaattctgtaagggaatccccacctctaccatcttccctaatgttccatggaacttctccacccaggagatacagaggtgatggaggaggaaaagcatcacactggagagaggcttctcttttgcttcactggatcatccagccctgctcctctgtggttttcagagccctggttgctgcatgagtgacagcacccagaactctgatgctgtgcttagttggaggtgtgaagcttgtgatggctcaggcaggagcgttctccagagctgaggctatggcagcccctagagctggggctccatgggaagagactgcagtgggcactgaagaccatgtttgggtggtcactttgcccccaaagtcatttgggagaggcttgaaactcttcctcgttttacttccaggacaccttaggggaagtttagtgactctagaaaaagtaaaaaggggaataatggcatgtaattgtatcagttttaaaaattggctattttcttatttacttcagagaatgtggctttgaatccacaacttagggaaaattcctgagcagatgagagtgggaaatggaaagttaacttgggtaaaagggtcttcatccagtgaggactgactataccttggagctgttttcttattttgttttgcaggcaagaaatgagtggtgggattgggaggggtgggagtgatgagtcttgtttaggagtcagcttcttcccttctgtagccccaagccctctgcatctccatggcaggtgtcaggagttatgaggagagcagggatccaagaaactccaatatccaagatattcatatatttctgcctcaatctttctgtaggtctttagctctttatttttcatttgttatcatcatccgttatttaaacaatttatattgagatgatggtgatacgagaggcgggcagggaagtgctgggtagagaagagtggggtccctggtgagggctccaccctcaggcctatgcccatggacctaagtgaggacaggcactcctggttttgcacccaaatgttgcattttctaagcccactctgacccaccatgccccacatcctgggcccataaaatcttcaagaccctagtgggcatggacacaagtggctggacgtggagaggagcagaagagcacactgactgataccagcagacgccagcaggccatcaacagcaggacctcatggaattcagtgggggcagttggaggccagctggccactgggtggtccgactccagctgaagcctatcttcccaccccatccccttgctggcccccccatccatctcactgagagctacttccaccactcaataaaaccttgcagtcattctccaagcccacatgtaatctgatttttccagtacactagagcctacagaatatgggatacagaaagctctctgtccttgtgataagtcagagggtctaactgagctgattaacacaagctgcctgcagaccgcaaagctgaaagagcacactgtaacacatgcctactggggctttgggagctgtaaacactcaaccctagacactgccatggggtcacagcccaaaaatgctcccaggacctgcccatttgcatgctccccctagcggttcgagcagcaggacatcaaagaagcgagtcacacccctgttgcatgccctgcaaatgggataagggaactcctcccatttcaatggcacactctgtgctgggcaaggcatattcaagagtaaagatactatccctacccttaggctgatgaggtagtggggctgagagataagtaggaaactaagtctgagccaagtgagggtgctgagatacacgtgtgtgggagtcctcaggcctgaggtcagagttgttggaggttagtcccttgttgctctgcagtgacttgtagtgaatgatgaatacagatggtgtcacctgctgtcacttgggatggttgacggggtgagtaagatgtggatcctgtgtccgtccaaggacagtaaactcaggcatggcaactaagaggaacttgtggacccaagaagcatgaagggggtgatgaggaggaagagataatggtggggtgaggaaggatggggctgacagaaacattgggacatctacaatcttgaggacaagatgatatgctcattcagagcatctggtttggagacaggaacttcctagtttaatctttggccacttctcctaatagctgtgtcaaggtagagatgcccaaggcagaaaaatctatatggagacaagatgatccagggatgtcccaggtaaaaccagagacagggataagaaatctaaaatggctgtgatggtaatgtgtcacagattaacatacatttaagacattatgtcaggatcttagtgactatagtattgattctaagagagccaggaaagagagtgattcaaatggctgggatggctaagagagattagtccaacgattaatggtaattaatgggtgtgttataatgaggttgatgggataaacgtgaacacctgacataaagtagactaagtttgcagagacagacctaaactctatactattttccatactatttattttatatatatatacacacacatatatatgtatacacacacacacacacacacacacacatttcatcctgaatcatgatatattaaaaataagtaaaaatgaggccaggattggtggctcacatctgtgattcctgtgctttgggaggctgaggtaggaggatcccttgagtctgggagtttgaggccagcctgggcaacacaggaagacctcatctctaccaaaaaaaaaggaaaaaagaaagtaagaaaaatatttaaacttcaaatatatgctcaaatcgcaagattttgataaaatattcttatttattttggtttaaaatggttgactagaagcagctagtgtgcactgctcttatggagaggatacaaagcagtgactaaatactagctcttcaagtgaattgtcaaagagatcatattgggatttaccaaggaattgacaggacccacagagagcagagaggagcaaagctgggcagccattcatctgagactggcacagagctgggggaagctccctaaagcagagaaagagtgagtgagagttcccggggactcacacttctgccatgaacctttgcaatactaggcataggagagcccctctgactccttgagcctccagaccaacacagagagcctgtgcagaggcaccagttaagtccacttggagccccataggccttgtatccctaacagccagtgccagctgctttaggccagccaaaagggggcctgggctcttttgcacacccctgggataactgctgctgctgcatggctgaggagtggccaggattcagactccatcccctgctgctacttaacagataaggcctgcatgcctgggctccccgagcagtggcctcacccccacctgaacagtgcagttagtcatggtcctatactcctctgcagcaaaactcccagagtaacagacaaggcttggcacttttgcatacccccaaccacaaaatccagtggcagcaatggagactggtggctatgggggcacatagcatgctgaaaatgggtccccagtctcttccagcttgtaaggtttctgatgagtagtccactgttagcctgatgggcttccctttgtacgtgatttgacctttttctctaggagcctttaagtctgactatatgcctgggtgatgttcatttgtatatgcatcacttggtgggagagaagtgtgagcatgccatgtgcccccatagccaccagtctccattgccaccacggagaggccctgccctccccagtgaaaggcccacagcacagccacctgccctgcctgaacatttcagctacagcccagagcccttctaaaaactgaaccctcacaggcctataatacttcctaaggctcttaccaccctaagcattctgtctgccactgcctaagagtttggcccatgacccagcccagcccttcccatcacagccaacacctgaactgggctagcctgacccttgtccaacccctttaggactcatacgcactgtccagggggccatgtaggaactggggaactccccaccccattacaactctgctggcacctgactacttgcctcatggcctgaagttgggctgacctaaccaaccaacaccaccacaaccagtacccactcacacagccccggtgatgtagcccctctacttataagaagtggctgtattgcctcattagagaacaggtgagcaataaagctatctgttttaggctgagtgacaacattatgctctgaaaacactcccatggagtatcacaaaacatgcatttcccatggctgtcaaccacattgtggtcaagagacagactacagtgtgcttctgaactaggagtcatgagttctgggtcaagggtatgatagggaaacagatcaacttcctgcctacctaagatgaggaagcagtgcagcttccttgtctccccacggagacttcagtgtgcttcaccagaagttcctgtcagccacccttttcagggcttgtgcctgtgcttgccattggagtattcatgggcaagccagggactccagttctgcccagtggtgtgcccctccccctgtggagcaggaagctcagggccctgggtgctccactgtccatcctgtcacctgaaataacaaagagcccttcacagtaaacaaaaattatacccacctgcttgtgctgcagctggatcttacctgcaagccctatctgctggcctgtaggttgaactgcacagcccaatataaaacctactaacataagtgcacagagctataaaaacaaagccaaaagactttttccaatatactttccagtcataccctaaagggaaagaaagaatatataggaaaagagaaaaaaagtctattttcatgaaaataattacaataattagaagtgccagcctttctagatgagaacaaactggtataggatctggcaccatgaaaaatctgaatgttgacacaccaccaaagtatcacactagttctacagcaatggtccctaaccaaatggaaaaacagaaatgacagattaagaattcaaaacatggatttcaaggaagttcaacaatatctaagatgatgttgaaaaacaacacaaagaaaattctaaagcaatgcaggaaacaaaggaagagataaacatcttaaaaataaatcaattggaggtaatgaaatggaaaaactcacttaggaatttcaaaataaagttgaaagctttatcaacagactcaaccaaacagaataaataatttaatagcttgaagactggtctttcttttttgtttttttaattatactttaagttttagggtacatgtgcacaacgtgcaggtttgtgacatatatatatatacatatgccatgttggtgtgctgcacccattaactcgtcatgtaacattgggtatatctccgagtgctatccctcccccgtccccccaccccacaacaggtccccgtgtgtgatgttccccttcctgtgtccatgtgttctcattgttcaattcccacctatgagtgagaacatgcggtgtttcgttttttgtccttgcaatagtttgctgagaatgatggtttccagcttcatccatgtccctacaaacgacatgaactcatcattttttacggctgcgtagtattccatggtgtatatgtgccacattttcttaatccagtctatcattgttggacatttggcttggttccaagtctttgctattgtgaatagtgctgcaataaacatacgtgtgcgtgtgtctttatagcagcatgcttaataaacctttgggtatatacccagtaatgggatggctgggtcaaatggtatttctagttctagatccctgaggaatcgccacactgacttccacaatggttgaactagtttacagtcccaccaacggtgtaaaagtggtcctatttctccacatcctctccagcacctgttgtttcctgactttttaatgattgccattctaactggtgtgagatggtatctcattgtggttttgatttgcatttctctgatggccagtgatgatgagcatttcctcatgtgttttttagctgcataaatgtcttcttttgagaagtgtctgttcatatcctttgcccacttgttgatggggttgtttgtttttttcttgtaaatttatttgagctcattgtagattctggatatcagccctttgtcagatgagtagattggaaacattttctcccatcctataggttgcctgttcactctgatagtagtttcttttgctgtgcagaagctcttaagtttaattagatcccatttgtcaattttggcttttgttgccattgcttttggtgttttagacatgaagaccttgcccatgcctatgtcctgaatggtaatgcctaggttttcttctagggtttttatggttgtacatctaacatttaaatctttaatccatcttgaattgctttttgtataaggtgtaaggaagggatccagtttcagctttctacatatggctagccagttttcccagcaccatttattaaatagagaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtagagtttgaagtcagttagcgtgatgcctccagctttgttcttttggcttaggattgacttggcaatgagggctcttttttggttccatatgaactttaaagtagtttttttccaattctgtgaagaaagtcattggtagcttgatggggatggcattgaatgtataaattaccttgggcagtatggccattttcatgatattgattcttcctgtccatgaatgtggaatgttctttcatttgtttgtatcctcttttatttcattgagcagtggtttgtagttctccttgaagaagtccttcacatcccttgtgagttggattcctaggtattttattctctttgaagcaattgtgaatgggagttcactcatgatttggctctgtgtttgtctgttattggtgtataagaatgcttgtgatttttgcacattgattttgtatcctgagactttgctgaagctgcctatcagcttaaggagattttgggctgagacattggggttttctagatatacaatcatgtcatctgtaaacagggacaatttgccttcctcttttcctaactgaataccctttatttccttctcctgcctgattaccctggccagaacttccaacactatgttgaataggagtggtgagagagggcatccctgtcttgtgccagttttcaaagggaatgcttccagtttttgtccattcagtatgatattggctgtgggtttgtcataaataactcttattattttgagatacgtcccatcaatacctaatttattgagagtttttatcatgaagggctgttgaattttgtcaaaggccttttctgcatctattgagataatcatatggtttttgttgttggttctgtttatatgctggattacgtttattgatttgtgtatgttgaaccagccttgcatcccagggatgaagcccacttgatcatggtggataaactttttgacgtgctgctggattcggtttgccagtatcttactgaggatttttgcattgatgttcgtcagggatattagtctaaaattctttttttgtgtgtgtgtctctgccaagctttggtatcaggatgatgctggcctcataaaatgagttagggaggattccctctttttctattgattggaatagtttcagaaggaatggtaccagctcctccttgtacctctggtagaattcggctgtgaatccatctggtcctggacttttttgggttggtaagctattaatttttgcctcaatttcagagtctgttattggtctattcagagattcaacttcttcctggtttagtcttgggagggtgtatgtgttgaggaatttatccatttcttccagattttctagtttatttgcatagaggtgtttatagtattctctgatggtagtttgtatttctgtgggatcggtggtgatatcccctttatcattttttattgtgtctattttattcttctctcttttcttctttattactcttgctagtggtttatcaattttgttgatcttttcaaaaaaccagctcctggattcattgattttttgaagggttttttgtgtctctatttccttcagttctgctctgatcttcgttatttcttgccttctgctagcttttgaatgtgtttgctcttgcttctctagttcttttaattgtgatgttagggtgtcaattttagatctttcctgctttctcttgtgggcatttagtgctataaatttccctccacacactgctttgaatgtgtcccagagattctggtatgttgtgtctttgctctcattggtttcaaagaacatctttatttctgccttcatttcgttatgtacccagtagtcattcatgagcaggttgttcagtttccatgtagttgagcggtttcgagtgagtttcttaatcctgagttctagtttgattgcactgtggtctgagagacagtttattataatttctgttcttttacatttgctggggagtgctttacttccaaccatgtggtcaattttggaataggtgtggtgtgatgctgagaagaatatatattctgttgatttggggtggagagttctgtagatgtctattaggtccacttggtgcagagctgagttcaattcctggatatccttgttaattttgtctcgttgatctgtctaatgttgacagtggggtgttaaagtctcccactattattttgtgggagtctatgtctctttgtaggtctctgaggacttgctttatgaatctgggtgctcctgtattgggtgcatatatatttaggatagttagcttttcttgttgaattgatccctttaccattatataatggccttctttgtctcttttgttctttgttggtttaaagtctgttttatcagagactaggattgcaacccctgcctttttttgttttccatttgcttggtagatcttcctctatccctcttttttgagggtatgtgtgtctctgcacgtgagatgggtttcctgaatacagcacactgatggttcttgactctttatccaatttgccagtctgtgtcttttaattggagcatttagcccatatacatttaagattaatattgttatgtgtgaatttgatcctgtcgttatgatgttagctggttattttgctcgttagttgatgcagtttcttcctagcatcgatggcctttacaatttggcatgtttttgcagtggctggtaccggttgttcctttctatgtttagtgcttccttcaggagctcttttagggcaggcctgttgttgacaaaatctctcagcatttgctcgtctgtaaaggattttatttctccttcacttatgaagcttagtttggctggatatgaaattctgggttgaaaattcttttcttaagaatgttgaatgttggtcttcagtctcttctggcttgcagagtttctgctgagagatcagctgctagtctgatgggcttccctttgcgggtaacccgacctttctctctggctgcacttaacattttttcgttcatttcaactttggtgaatctgacaattatgtgtcttggagctgctcttctcaaggagtatctttgtggggttctctgtatttcctgaatctgaatgtcagcctgccttgctagattggggaagttctcctggatgatatcctgcagagtgttttccaacttggttccattctccctgtcactttcaggtacaccaatcagatatagatttggtcttttcacatagtcccatatttcttggaggctttgttcatttccttttattcttttttctctaaacttctcttctcacttcatttcattcatttgatcttccatcactgataccctttcttccagttgatccaattggctactgaggcttgtgcattcatcatgtagttcttgtgccatggttttcagctccatcacatccttttaggacttctgtgcattggttattctagttagccattcgtctaatttttttcaaggtttttaacttctttgccatgggttcaaacttcctcctttagcttggagtagtttgatcatctgaagccttcttctctcagctcttcaaagtcattctccatccagctttgttctgttgctggtgaggagctgcattcctttggaggaggagaggtgctttgatttttagatttttcagtttttctgctgttttttccccaactttgtggttttatctacctgtggtctttgatgatggtgacgtacagatggggttttggtgtggatgttctttctgtttgttggttttccttctaacagtcaggaccctcagctgcaggtctcttggagtttgccggaggtccactccagaccctgcttgcctgggtatcagcagtggaggctgcagaacagtggatattggtgagcagcaaatgttgctgcctgatcgttcctctggaagttttgtctcagaggagtacctggccatgtgaggtgtcagtctgcccctactggggggtgcctcccagttaggctactcgggggtcagggacccacttgaggaggcagtctgtctgttctcagatctcaagctgcatgctgggagaaccactactgtcttccaagctgtcagacagggacagttaagtctgcagaggtttctgctgccttttatttggctatgccctgcccccagaggtggagtctacagaggcaggtaggcctccttgagctgtggtgggctccacccagttcgagcttcccagctgctttgtttatctattcaagcctcaacaatggcaggcgcccctccccaagcctcgttgctgccttgcagtttgatcttagactgctgtgctagcaatagtgaggctctgtgggcgtaggaccttctgagccatgcacgggatataatctcctggtgtgccttttgcttagaccatcagaaaagtgcagtattagggtgggagtgacctgattttccaggtgccgtccatcacccctaggaaagggcattccccgaccccttgcacttcccgcatgaggtgatgcctcgccctgcttcagctcaggcttggtgcactgcacccactatcctgcacccactgcccaacaatccccagtgagatgcacccgatacctcagttggaaatgcagaaatcattcatcttctgcattgctcacactgggagctgtagactggagctgttcctgttcagccatcttggctcaaactaacccactcagactgtgttagtctgaatgaagaatatgaagaaaaagaatttaagaaattaacaaagtttttgagaaatatggaattttgtaaagtgatcaaacctatgaattattggcatttctgagagagaaggagaaggactcaacaatttggaaaatatatatgagggattaattcaagaaaattttcttaatcttgctagagggatagacatccagatataggaaaaccagagaacacttcgcagatactgtacaaaatgaacatcaccaaggcatatagccacagactgtcaaaggtcaatgctaaagaaaaaaatcttaaagccagttagagaaaaaggtcaaaccatgtacaaagggaagcccatcaggctaacagaggattactcatgagaaaccttacaagccagaagaaattgggggcacatttacagcattcctaaaggaaagaaattccatgcaagaattttatatcccatcgaactgaacttcataagcaaaggagaaacgaaaacttttccaaacaagcaatcactaatttgttaccactagaccagccttaaaaaagatccttaagagatttataaacatagaaacgaaagaacaacatgtgcaaccacaaaatcacatgtaaatacatagtccacagtccctatacagcaaccatgcaatggaaacaacaaagccatcagccatcaacttcacaagaggattaaaacttcacatatcaatattaaccttgaatgtaaatgatctaatgccccacataaatagcacaaagctgcaaattggaaaaaaaaaacaagacccatttgtatactgtcttcaagagactaatttcatatgtaatgacacctatagtctcaaagtaaatgggttagagaaagatctatcacgtaaactaaaaacaaaaaagaacagggatatatatatatatatatatatatatatatatatatatatacgcatatcagataaaacagactttaaatcaacaagtaaagaagggcaaagaagggcactacataaactatagttcaacatgaagatttaactatcctagatatatatgcatccaacattggaacacttaaatttataaaacaagtacttctagacctattaaaagacttagatagccatacaataatagtgggggacttcaataccccactgacagcattagacagagcatcaaggtagaaaactagcaattctggacttaaaatcaacatttgaccaattggacccaatagacatctacagatccctccacccatcaacaacagaatacatcttcttatttgcgtgtagaacatactctaggattgaatacatgcttggccataaagcaagtctcaatatgttcaaaatcattaaaattatgccaatcatactttctgatcatagtggaataaaatggaaatcaatataaaaagatttcttaaaaactacaacatgagttggaaattaaacaacttgttcccaaatgacttttgggtgaacagtaaaattaaagcataagtcaaacaattctttgaaataaatgaaaacagacacacaacataccaaaatatctggcatgcagcaaaagcagtggtaagaggaaagtttatagcactaaatgtctacataaagaagttagaaagatctcaaattaacaatctaacttcatccctaaaggaaccaggaagcaggaaaaactagccccaaagctaggagaagaaaataaatacttaaaatcagagcaaaatcaaatagaagagacctaaaaattcatccaaaggatcaataaaaccaaaagcttgttgtttgaaaggataaacaagatcaatagactgctagctagattagcaaagaaagaaaagtacaattacaaatgacaaagctgacattatgacccagcccatagaaaaataaaagatcctcagatactattatgaccacctctatgcacacaagctagataaactagagaaaatgaatacattcctagaaacacacaaccccctaagactgaatcaggaacaaaccaaaaccctgaacagaccaatattgagttccagaattgaatcaataacaaaaaaacttaccaaccaaaatgagcccaggaccagagggattcacagccaaattatactaaaggtacagagaagagctggtaccaatcccactgaaactattacaaaaaaaacgaggatgaggggctcctctcaacctcattctacaaacccagtatcattttgataccaaaatctggaaaagagacaatgaaaaggaaaactattgcaaatatccctgatgaaacagatgcaaaaatccttaacaaacaaactgaatgcagcagtagctcaaaaagctaatgcaccatgatcaagtttgtaggctttattcctggaatgcagagttggttcaacaaaaagcaaatcaataaatgtgattcaccagctaaatggaattaaaaacaaaaaccatatgataatctcaatagatacagaaaaaacttttgatgtaatccatcattgtttcataataaaaatcctcaacaaactaggtattcaaggaacatacctcaaaataatgagagccgtctatgacaaacccacagccaacatcatactgaaggggcaaaagctggaaacatccccttaagaacaggaacaagacattaattctcactcttaccacacctattcaacatagtgctagaagtcctagtcagtgcaatcagccaagagaaagaatacaaggcatccaaataggaaaagaggatgccaaattctctctgtttgctgaatgtaaaataaaagttgaaataatataataaaatcattattcaaaaaattattaataggtattttaaaaacactattattacattaaacatgtctgagtatcctgatacagggaagtctgtaggtgtggccatcttttttatttgctcacatacattatagccaagtaggaaacaaaagcactttcaagacacttgggtgaatggggttgttccctgagaatgagactgggaaaggacgaggacttttcaactttcaaacaaacatttcatggttggaataaccacctattccttgcctcactaaactcttaccttgggtgtggaagcaagcagatattagatgtcctttttgtatccactaagacaatgatatccaatgtcaaaagtttgcccatgatgggtgccttcactgggtttagctactctttaccagcatctgtcaagtgccccagagtgggaatccaattgaatatagagccacctttgtctaaatctgctgccaagcaaggaagccagaagatgcctccaatgggcccctggaacataagctccctgagaggggactttgtcttgtttcaaactgatccaagtacctagaccagtgccaaataagtatgtagtgaatgaataaatttttgaatgaatgaggcttggcctagaagtcccctgatgaggactgaaaagtctgtcttcacacttactgagacctcacttgtaggaatcagcttccagtggcgggtcaccactgccataacttctggctcccatgaactgtactaatgtctcaacccaaactttcttagttgattctggtgccacctttctacatcttggggtaattcactgacagcaggagttctggtggtactttggagcacagatctgactccacaggcacagctaggtctctgtgcccaggtctagggatccttttttttttttttcatatttcttaaaacattttagaggaattcagggtaccatggtggtcaggagcatgtggtcagtgaaactgtctgggtttgcacggcagcttctgggagaccttgggcacccattctacattgattcccctctgtaaaatgggagaaggctagtatctaactcaaaggactgcagtgaggattaagttatttactgtatgtcaagccactggtacattatgagtcctatataaattatagatcctatgaatacatatccaatttgcaactcctgaaatgatctcattttttcccctttccctaagttcctctcagtatatgcccttgcaaacacctccatttctctctttgcacctgtcacctaattagctttcaaggatcccttcctaccccgtcaacacccagatcttccctatagaaataatatgaatgttttctctgcagccgtgtgtccttctgcaacctctttccagtcctaacacataaactcctcacggtctccctatgaatggagataagtgacatttctcattcttcttgtcctgtgaggcactcagcctgggagataagaaggggaagagcaatggagcagctttgggaggggcaaaatagaaatgtaggtggagaagagaagctttatttttcacagagtgagacataagtgctgctaagcactgaacagaacatgggtgtggagacaaccatgagggacacccagggagaccgctggagatcactgacaaccctcttcaggatgaactcaggagctcagaccatgggcaggaggttaggagtgggtacatcagactgaggttaatcctgggcactttggtctctggttcctttaaaattgctcatctcaatgtactgccaaggtcagcagtaattctctagcaatggctggagcccctggcaggctcactcacagcagtagaggctgtggtgcctgtgccagtagaaaagatggggcctttgataggtcaagcagcagtgccccactaaagttaaagtgacccctgaactggggctgcagggaaaggctggaggtgggtatgaggcttagtactggggtgtgcactttgaaggctttgggggttatcactgctgctggttttgctggagggcatctcagaagacatcaatagaatcagatgtgcttgtaatgcacaaacctctgtcaatatctcttctgtgatgggtgtcatagaccccatgctctcctactgaactaagaaatacacggaagaaatgaaaagttacttggagttagtttaccttggaaaaatgcgtttttctctggtctcctactagaaaaggatgctgagtcttttctaactgggcccctcaggtatcttatctccatgtaatcacagaggagaataagcctgtttgggtaaaccttccttgatgatgtctggtgagatcagtgcatctcgcagaacaaatgtaggaagaagatgagggtgtgctgaaaacccattaccttcacagtcacaggacacctgaaacatcctgagagggtgcccattaaccccacactcttcctggtgcctccatcccagaccctctgcttccttctcccctgatggaagcctgggcttgtcttcctaggtcttccagctcaggtcctgtctccagctagacatccatctgatttcatagaagccagagaatgctgattttgagaagtcagtggactggggagcccaggacaggagctcctagcatgtgaggggcagcatgagtgggctgctgggggagttgacagcactaagtaccccagcccagcttcaggacttatccaccttccctggaacaggatggcatgtttgaccacaaagagcctggtcctcacttgtgcatcttccacccaggcctacatgtgtccttaaaagaggctgtgccctgtgctttgtggtgaaaggtagagttcaatatgacatgtcacctgacctatagaaattaattgtctaattgcacagacaaacaagtaaatagggagcctgcttccatgagaaaattgctataatgtaagtcactatgcacaaagtttgcaggtctttgtccatatacttctttctagcatgttcccttaggaaaaccaaacacccagatgtggtgttggggtggtgacttgctgttggggcggtgactgagctaaggacgctggacattcagtatgggctgtgtgtaaaacagatggaagcctaaagtcaggggaggtgagggtccctgaaagagcccccgggcaggagaggaggggagtcaaatgagtacccgattgaagggcaaatgtagagaaggaaagtacaatagttgcagtaataagagtcacaactgacgcattataaaaaagcatgaccttccatcaaaatccaaggaatgcgtgctctttatttgaagacgatgaaaacactgagggaggagtcgttcatctgcttggactcggtaaggaagttgtgcaaatgtgcatgataatggatggccttgatgaagatggctttgctgtacgtgttgctgcttatgaggttgatggtagtgctgggtgcatctcttgtaatgaagctgacctgatggtgtctatgtttgggtatgccgaattggtgcaaactgaatgctatttccttgttaatttcattttaattttaaatgaatttatcattcaattaatctctaatattaaaagaccttttgctagatatttttcaagataaatcacagtcaggtctataaccaaactttagccatattaaaattataattttcaaagaaaattaaattatgttcattatcagtgggtgtaatttttctcttactctgcctaagagtttgcccctttaagtacatagtgatgcctgtaggagcataaatgcaccgggctgtaaggaggacagtggctctgtgtggatgggtagagggtgggtgcagattttgatatcctcagcagccttttcctgcctccagcccatggtacctgcctctggttgaaaggtattttcagaatcatttccagaactactcctgagtggccgtttttctcatattgtttagggtttcttcagtagaccctggcctgcaaaaaggcacttaagaaaaatggaccaagtactttctcatggtacctagattgtgaagctgaacaaagctgggtggccacttttgcttcttaggtgtagaatctctagtatttgggatacaacaacagaggagtaagttctaaagtttcaaaacaccccagaactgtagtgggggccctccttctgtctcatggaatgcagcagatgtgtgcatatgggcctctccacagcccctcccccgatgcctggcttgggaggctccatacttgtcctggtgaggatgcccaccaaactttcttcccctccacgaggaactcccactttttggcccctctgtttgttatcagagcaggagctctgtaggttcaaggctgagcaggtgtcctgggatgacagaggcttggctggaggaccactgccctgccacttacccagagcatgacatcagctctctgagggtaatctctaccaggagtaccacccttagatctctggctttctaaggttctgtgaggtcaggtgacaagagaacctggcctggctggatatatctggataatttcatgacttagtagtgccaatgggaatgatgggcacaggtggtatagtggctcaggtttggctctttggagtgcattttaatcaggtcatataaaatacacgtaaatgactatctaaataacaaaaagatctttttcattccctgcagaacacagcttcctttcagtttaggaccttcccatccccaaaccattagcatgaccatggcaagcagctgagacaatctgggttctcaatgttatccttgtgtccctagtggagacacaggtaccacagagagatgtgaagccctccatgtggtggttgggagtaaaaggggaatggaagagagccttactaatggaaaagatccaggaatcccccaaactgtccaaatatctgttctttaaatcttctgtaggcctaccatctcttatttttctttttgtccttcctcccctcatcccttctcttcttccttcctgccctcctgcccttctctttcccttcctgccccctccctctctattccttccccattccctttccctttccctacctttccctccttctgtcattctttccttctttactttggaatatgttgagctgaacaactgtaatctctattactacgccctctatatcttcttgggcagatgctaagagtttttttgtgaggaaagtcacaggactcttgaaattcctggggcccagccttcctgtaggcctgtcactttaattttttctttcattcagtcatccatttattcaattattcaagtgagatgtgttgtgctgatatggcacaccaggcattttgctatacacaggagagttataaatgaataagatttgttctctgttcttgagtagctcacagtgcagtggggcagacagacaaataacaaaataagcatgatccaatgtggcaagtacaggaatgcaggtgtgtggaatgtccttgggctcaagttcagaccctttgggtttcaaaccccttttacttggagtgactctgtgggggaaaatgtgtctagatgttgccacatgctatcatttgaggatgagatcactggcctttgacaatagtatctgtgcaagtagcaggagcagaggtataaatccttgatctgtctgtgggcagccagccaagatggtgataccaagaggagctaatggaacccagctcatggaacctcaccaggaggaagagataatgctgttgctaaggagaagagagctgagggggaccctgagggatctaagacaaagtggagggggcaggataatgggcttgttcagagcattcattttggactcagacattcctgagtttgaatcctgcttccccaggtagcagctggtatcaaggtgggaagctataaagtgataagaggcacaatggaccaaagatgtgaggggcaaaatcagagaaagagacaggaagtctatagaggctgtgaggacatggtttacaaattaaagtacatctgagggccattgtatcagtatcttagtgactgtggtatttactctaagagctccagagtagtttcagggagggagtgatccaccttagttggggtggctaagggaaattagctgagctgtgaataatacttcatggatgtagtgatgatgaggccaacagtggggaagcttgtgaacactgaatgggcagtgattgaacaggatttagcaaattgcaattacataagctatgtagtattttttccattgcattttatataacattagagatgcattgcctctgaaacaccacctttaaaaatgggacaaatcttttaaatcaaaaacacgaattaaaatgatcacaaaatgttactgtcttttataaacgttgatgaaaattttgtgtctggttatcctgttacagggaggcgtataagtgatgaaatctccattagatgatgaaatagttaatatttgtgggatgaaaagtgaccctgtgagaagaggtttattcacagggctgtggagagagggagggagatggggaagggcatgaggagagaggcctgcttgtgcaataactttgtccccttggtagtcatgatttatcctttcttctttcttggctgttgtcttttgatgtggaagctagaaaacacttgatgccctttccttttgtcaccaccaaagccactgtctcagagcctcaatattttgcctaggctgagtgtcttctctgggtttattaaataaacaccagtgtccactcacctccagaggctgagaggccaactgaggagaaggccactgtgattcactctgcgatgcatgcaaaatcgggaactgtctcctttggaccagttttgaatgtgaggtcccaaaagacagaaatttgtctctctgattccttattgtgtccctagtgcctacaatcaagcacataatcaatgctcaataaaaatgtgtcaagtgaataaatgggtccagggctcaggacttggtattgcccagatgcagtttgggactttgtttttctctgctgctggaaactcccttattgggctccatttttgagaggtccttttatacttctttatagattcccaggatctcattgatttgccagcaatgttgactctgctccattttctctccactcagattcgatccaaccatagccagaaccccgtcattcttcagtgtagtggaatgaggtgttctgggcctccaaccttgttctgcagcccctgacaggaggcaggctctaattctccagttttgtccagcctgtgtcatgctgcttccaggtctgcacagagatgctgggtctgcatgtgggtatcactcacattccaagtgtggagctttgcaggctgtatcagccatggcacactcttccctgggggcaggcctttcacccccttcactgtccctgggtgagagctctctagtgatttcaaaccgaacttaaaccaatggcccaaagctgtgcctcctgcttcaatttcaacaaatttctctctttttttaaatacctattggtgcgtatctgaatatctgatattaaacttctctcaggttctttttttttcttatttttggaggtggagtctcactctgtcacccaggctggagtgtagtggcacaatcagctcactgcaacctctgactcctggttcaagcaattctgcctcagcctcctgagtagctgggattacaggtgtccaccgccacgcccagctaattttttgtatttttagcagagatggggtttcaccatgttgtccaggctggttttgaactcctgacctcaagtgacccacctgccttggcctcccaaaatgctgggattacaggtgtgagtcaccatgctgggcctcagggtctttttgatccctaaattttaagaattaatttataggatttgacaaaatccttttttagttcaatggacttataaggttatccatctttatttttaatgccccccctccacctgctctacttagccctcacatcaacttctcttagtatttgtaatttgactgtagctctacgtgacacttctctggttttctggtagtcaaagtgagatgttactcttagttcacataaaaaaacattccttcaaccccaggagcatctcagtctcacaatttaggccaaaacatgtgactccattgaagttgtaacttccatgtgttgatgtcaaggtcgtgtagttacaaaattaataatttgttgcttctttggtatatctatttataattccaggaacacttctcattttctgcctttttctttttcctaaaattctcattttgcacattccaataatctcattgagtaaactcccagccacatctctgctccattatctcattaatttaagcacctctctcagctttcatctctctccctggattttcagtcactgagttatacttcttcccaaggcttacatctcttccctccatcttttgattctgcttctcttctgcctattttctgcttttttgccttttgatttccggtttcttagttagcactccagaaacagctcatcaaaacaaactagtggtcttctgtcatacactggaaattccccaattgtattaatgtcctctcagattttacaggaaaagtcaatttttgcactgataccctctttgagtttgaggttgagtttcagggcctcaaaccagcacaacctgtgtcgttctctccctcccactacaacataaaactctccccttcccttccatcagtggagcggggtcggatccactatgttttcctggtgcagagataaggtttggctcctgagctgggttgtactgaccaaagagctgaggagagagactgtgaaatgcccagtgggacgctggtggtaatgaggacaaggaactttatcttttttacgaggttgggcacaagcactgccaatccttggcaggtacaggggtagggggacatatgacatcctgtacataaaacaagaagtgccttctggggagagctcagatcccccacaggaaaacctccagctcagcctgtgaaagtcagaagagggtatatgggaaggcatgcgtcagatggggctgttcttggcctcttgggattcttgtttcctccaaagatcgcttgtctcagcatcaggatctggatcagcagcagcccccagaaccgtggcagcagccagagcccccgccttgctgaccactgcccctgtcacaggagttggacctctggcgccggcatcggtggtggcgcctgtggtggttcaggaagcagccgccctcggagctagggccacagcccccagagcttggggcacagccagaggaagctggaggcagacactgtactgggttctttgggggacacttgggtgaggggcacttgggtgggggttggcactgcttctggttctgctggcaggacatcttggcaggagttgagatgtcctggagaaaacgaagccacttcttagttcaaaatctacagtccaacgtctctaagaccagctgcctcctgaggcaagagctgcaagagggtgagggaagctgatgtggagctggtgggatatgccagatacttctcacattgctctccacccgggacagattgctgtgagtctaagtgggcacgtgtgtttctgtttctccaaagaacccctagggaatgcacccttttgggaaaaagaattctgtagaatggatgttacaggaaatgtgcctgcctgagtagaaagaggatgggagggaattgtgagctctgtggcctttgcaggtcatggaattgctgtcagttcctgcagggtctccctcctgcccccttcccccattgctgccctctcacagtcctgtatctgggtctttgtttcaaacctctctgtttccatctcttctgctatggccttagctttctgttctaacatcccatatcaagccctgtcccctgctgaatacttaccaggtgcagagaggcaggagaaggctgttcctgaggagactgtggaggagcccagggcaggagtgcttttatcctgtgcagggtgtgtgatgcacaggctgggcatgctgctgctttcacaaccaggggaggtgacagccaggcacacccttgagactatccattcatcaccttcctgtgtactcaccaagatgcctgacaagagggaaccaggaaggtctgacgcctgtttaccttcacctcattcaggcctgctgggggttgcaatcctaccttccttgaagcaattgtttttatcaccactcattagtagtcactccttattccacattgcccctctggcaactagtaatcaattttttgcctgtatggacttgcctattctggacacttcatataaatagaatcatataatatatggcattttgcattagcttctttcacttaatatattgtttaagatttatccatgctgtagcatgtgtcagaactccattcttctttatggttgagtaatatttcactttatgaatttagcacgttttatttaaccattcatcaagtgatggacatttgagttagctccaatttttggttattgtgaataatgcagctacaaacttaatctttattatttccttcctcctgctttatgtttagtttcttctttttttcagtgttttaaggcagaaggttaggtaattgatttgagatttttcttcttccttaatgtaggcatttgcagccatgtatttccctgtaagcatttcctttgctgtatcccataatttttggtatgttgtatttttattttcattcatctcaaagtattttctaattctccttgtgatttctttctgaactcattggttgcttaagacatttctgaattttccagttttccttctgttattgatttctagtttcattctcctgtggttacggatgatactttgtatgatttcagtgttttaaaatttaatgatacttcttttatgacccaacaaatggtctaccctgcagaatgttccatgtgcaattgagaaaaatgtgtattctgctattgtggttggagtgttcaacaagatgtctgttagatttaattggtttatagtgttgttaaagtcttcagtttgttgattttcttcctagttgttcttccattaatgaaagtggagtatgaaagcttcaagtattattgttaaattgtttatgagttgtctgtttctcccttcaattttgttagtctttgttacatgtaatatgggactccattgttaggtgcatatatatgtataataattatttctttaatagatatggatccttttgtcattataaaatgtcctctttgtctctgccattaatttcgtcttaaagtctatttcgtccagtattgtatagccactccagatctcttgattaccattgcatggtgtatgtttttctaccttttactttgaatctattttgtctttgagcctaaaatgtgtgtcttatagatagcatatagttagttcatgctattttatccattttgccagtcttagccttttgattggggtatttaatctattcacaattaatgtaattactattaaggtagaatttatgtctaccatttactatttatttcctatatatttcataactttctttgcccctctttttcttcactatggctttgttttttattgaacaggcattttctagtatacccttttaatttcaatgttatatattttagtatattttttgagttattttcttagtggtttccttgggagttcttattaacatcttaacttacagtgattataactcagatcaataccaacttaattttgatagcacgcaaagctttgctcctgtgtaggtttgttccctcccccttctgtatactgttattgtcatataaatcatatctttacattagaaggccatcaatgcagttctataagtatttctttatgcagttgtctttcagatcaaattggagaaaaaagacttaaaagcacaaaatgcatttatactgtcttttatatttaccatgtagttaactttacaaatgctcttcgtttcttcataaaaatttcaaatactctctagtgttatttcatttcagactgaattaatccttttagtattttttgtagagtagggtttctggaaacaaattttctcaatttttgtttatctgggaatgtcttaatttttggagaatagttttgctggatatagaactcttggtttactttttttttctttagcactttgaatgtgttatccaactggcttctgtcctccatggtttctgatgagaaaccagctgttaatgttattattaattttttttgtatatgatgggtcttttctcttttgctgttttaaaaattctctctttgtcttttgacatttgtactatggtgtgtttaggtgtggagaggtttgactataccctgctaggagtttgttgatcttcttagatgtgtagattaatatttttcatcaaatttgataagtaattaactgttattcctttgaatattcttcctgtctttttatttctctcatctcctcctgggattcttattataaacatgttggtgggcttgatggttactcacaggcctctgaaggctctgttaatttttattcaatcttatttctttctgttcctcgggttggataatcacaattgacctatcttcaagttcactgatttgttcttctagttcaaacctgctgttgagcccttctagtcaattttaaatttcagttattatatttgtcaagcctcaaatttctatttggttgttttaagaaattctttttaattctttgttgttattctctatttggcaagacaacattcttatgttttcttttaattcttaagacgtagtttattttagtactttaagcacatttaaaatagttgatttttatctttgtctagtaaaaccaatgtttaaacttcttcagggacagtctctcttgactacctccctggactttgccccttgtgtaggtcatactttcttgtttatttgtagctttctttcttttttggttaataattggacatttaaaatgatataaaatcctggaaatcaaatttcccaaccctctctggggtttgttgctgtttgttttcactgtccatttgcttcatgactttcctgaaccaattttgtaaaatctgtattctttattgtgtgtagtcatttaactctgtactcagttagcttagtagacagagatttccttaaatgccttgagttaatgtctttcaacctttgctgaggacctctgtgtgtatgttggggcatgttttcaagacttcagaagacagtttacaaatctgtcttaggtttcatttcctgcttggatggaacttcaagatcagtcaaagttgagatattagggtcttcccaggtcttttctgtacatgcacacaccctgtaagtccacatagtctcctagatttccagaaatgtgtcatagatttttaaaactctctatgagaatctcattcctcagattttccatctaagtttttggtcaacttctgatttgcccaactattatcaccatcacaggcagctgtgatgctaaacattttttactgattgtttttggcaaacaccctggggtaaaagctgttttcagtgagagagttctgagtcaactggaatgaaaacaagcttggctagttgggatttctaggggaaatgggaatgggatcttcattatgtgccatatagtcagataatgacatttctctagggatggggtttttggatagtttcagatatgttctgttacctccatgtgctactagcattttagatttcaagactattatggcactgggaacagggagatgataatagggcaagttaaaatgtcacaaagctcactgctcttacccatattcaactgcttttcttaagtgaacactctaatatttttgcaagcctttggtaaatctccagagttttgcaaaagttgattttcacaatttttcattttcaaggtgtttttaatggaagagcagatttttggagatccttgctcaatcattcccaaccttgtcttcttaagtgaaaacatgagtccctagtttttcatctgggtcacaaacttcacatccaataagcattattattttgagatatacagctcttctcatcaccacagagatgcttccatataatatccaggtcatatatgagaaagtaagattaagcttttcctgttttattgagatttgacaaaaataactgccaacttgtaaacaataggcacaaataactctccaccttataaagaggttggaaggagccctgagatgctatcactcttctcttgttatagtaatgagaagttttcaaaactggatagaatgctgtggattttccccttacatttcacatggggaagcaacaggttattactcttaccctccactagaggaaaagtcatagaaatttcaaggggacaaattgtagaacttatcaatgcctaaaaaacagaaagacttggccagtagcggtggctcatgcttgtaatctcaacactttgggaggtgaaggtgggtggatcacttgaggtcaggagttcaagaccagccttgccaacgtggtgaaaccccatctatactaaaaatacaaaaatagctgggtgtgttggctggtgcctgtaatcccaactacccaggaggctgaggcaggagaatcgcttgaaccagggagacggagtttgcagtgagctgagattgtgccactgcactccagcctgggcggcagagcaagattccatctcaaaacaaaacaaaacaaaacaataaaacacacacacacacacacacacacacgcaaaacccaggaagactaaaatttcaggtctcagtgtcatcattggacttgctgaacagttctctggctattctggagagtgaaaaataattggaaagggaaaatggaaaggagaatggggaaaagagaagcagccagtcccttactgcttgacatggccagagttcatgagtttccctgagccagtggacagtttggagggcagctaggcatagctgtactgccacagtcctgctgggaatgtggctatcaaggcaagaggcctgtaccaatggggctaagagtgcaggggagtgtcaaaagaggccaaatttttcacatcaggtcactgtgctaaaggttccttaaagaaatcagtcatttatctggtaagagagccctcatgggtcagcacagagaggatgcagccactgagagacactagcagtaccagccaaatatgagatatttgctttgtccccccttttctcattccggcctcaaaacagtgcagaataaagggaacccgcaggggagaggaggaggtggacaataaatgatggaactaaccatgtctcttttccacacactagatgcctgttttccacacagtcctttaggagacagttgggctgtgctgggttggagagggaggagttaatattcttattctgagttatatccaactggacaggataggatgcttcctgaatacctgaaaaatgattagaaaggcctgaaacacacttgagatattatcaaagtagagtcagtataacatagtagaagacagagactagaggaaaaataagtcactatttgtatctgacactgagttcagactacttaataaacttcagaggcccttggaagattttcctgccaaggatctctcttggttcttcctctctttccaatatcagtcaataaataaatcaatactcaatttcataaattgcataatattttttaaactgcatttaggaaaacattccttcttggagctaattatcactgtaaaatcagggctttgtggtgaaaaatgtgaaagacttcagatgtcaacaatgaaaagttttgtctccaaactccatgtcaccctcaaaaccttcagtttctgtgagctatcttgggtggtctgtgacatgatctttctttactcttgagctgggctccaattttcagtacaggtcatggtgggcctggagtgctgaggaatgggtcagacctccaatcatccagggggctttgagttgctaagagtggtgtagggaaggcagataaagttgaagaaagttttgttatttcagaaagtcacatatagaaagaggagatgggggtcggggaggtagggagaagatggatgccaggagatcagggagggtggaatttctggagagaagagaatcctctacctcagaagttctcagctttggctgcacattggcatcatcttggagggttttttaaaaatacaaaactctgagtttcatccctcaagacgctggttggcttgggctaggcatcagggttttagtatctcccaggtgattctgatgcacagtcaggtttgagaggatcagatcacatgaggtggaagagaaagaattggaggttggagaatgagatcacctgtgggcttacgtgcatacgtacctattgtccacaaaacaaacaaaaaattctttggctacagtactagtctctggctggtcaggaactggctgatttctctagtctcaacttctactatcctcttctacttctttacctgtctttgtcacaccaaggggtctgaggcttctccctgggcctgagctggggggcaccttagtgactgaagcttggtgctcagggagtgtctgtctgaacaccttgaggaaagaggcagatgtctcaggaagttctagttcatagactctctggacaggatcttgttaccaggttctatgttgcttgcttataggctgcagggtcctggtagtaggcgggggggcgggaggtgtgggggaggaaagagtaagtttttctaagagaaggatctgggatgccccaagactgtccgggtacctatttcttaagtttgtttttggtgtgttttcttctctttctcccatcctcttttgctctccccctctctttacattccttctttactttcttctattctctaaaaaatgaacagatattacacagtgggcatggtgatagatgtgcaatccattggatggtggacacacctaattataaataaatgagatgtggttctggttgagtagctcaccttgtagcagggcagacagacaggtgatcaaatgactatgacccaagatgatgaaagctacataaaacatgtgttgagtcctgaggcttatgcaagagcttttggctatcagtctcctgtctcctcagtgtgcccagaggttgtcatttggtatcacttgagagtagttgaggtgaggtcagcagcctataggagctgatgatgggcatggagcaggaacaaagggataaggagtctgacctccccttgcagtttatggtcagagagacacagagaaactcatgaaacctaggaggcagaggtgtccctgcagagagaagggggatggacaaaattcctgtctgaggacagaatgtggtggatagaagcggccagaataataggttcattaagaacataggttggggagtcagatatttcaggctttgttttcttatttcttcaggtgatagttgtcataaggtaaaggtgtttgaagagagaaaaaactacaatggaatgaaagcacagtggaccacggatgttagagctgcaaccagagatggagataagaaactaacctacatctgatgaacgatgtgtcagtaagccactcactttgtaagtttctgagttgcagacatgggtcagagaagaaggtgattcacccaggctgggatattcagggagaatttatctgaaaggtaattataattaattgaaggtgaataattatagatacattttgtagtgttattatgtatacctgatgtaatgcaattgatgtgtgactaatgcctgtaaaaactgcatttgaatcagctctgtagaattttcctattgcattttattataacaataaagacgcattttcttctgaaatataagcatactcaagaataagacaaatcttttatatcacacaggtaattaacaatatgtatttttttcagacaaatacaccagtggttcagaatagaaagccaaaaaataaggccacacacctacaaccatctggtattcaacaaagctgacaaaaacaagcaatggagaaaagactcctagtcaatacatggtgctaggataactggtcagccatatgcagaagattgaaactagactccttccttacaccatatacaaaaatcaacttaagatggatcaaagacttaaatgtaaaacccaaaattataaaaaccctggaagacgactgaggcaataccattccagacatagaaatggacaaagattttatgacaaagacaccaaaatcaattgcaaaaatgacaaatgggatctaattaaactaaagagcttctgcacagcaaaataaactatcaatacagtaaacagacaacctacaggatgggagaaaatctttgcaaactatgcatctgacaaaaatctaataatatccagcatctataaggaacttaagcaaatctacaagaaaaaaaacaaacaaacaacccaattaaaaagcaagcaaaggacatgaacagacacttttcaaaagaagaggtgcatgcagtcaataagcatatttttaaaaagcccaacatcccactgatcattagagaaattcatatcaaaaccgcagtaaggtatcatctcaaaccagtcagaatggctgtcattaaaaagtcaaaaaatagcaggtgttgtaaggttgcagaggaaaaggaatgcttatacattgttgacgtgagtgtaaattagttcaactgctgttggagacagtgtggctattcctaaaagacctaaggaccaaaataccattcaacacagcaatccgttactgggtatatacccaaaataatataaatcgttctctcgtaaagacacatgcacacatatgtttattgcagcactactcacaatagcaaaaacatggaatcaacctaaatgctcatcaaagagagactggataaagaaaatgtgatacaggtataccatagaatactatgcagccataaaaaagagtgagatcatgtcctttgcaggaacataaatggagctggaggccattatctttagcaaagtaagacaagaaaagaaaaccaaacactgcatgttgtcatttgtaagtggcaggtaaataatgagaacacatggacacatagagaggacaacagacacagggacgtaccagagggtggggaatagaaggagtgagaggaccagggaaaatgactaatgggtactaggcttaatacctgggtgacaaaataatctgtacaacaaatccccatgacataagtttacctgtataacaaacccgcacatgtacccctgaacttcaaataaaagttaaataaaaatgcacggcttttgagaaaacattattagtacagtaaatgtgtctgtttatcctactacaggaaagcctatagttgtggctacccactttgagataaggtctaacaggaggaaaatgagagtaccttcatactactggtgcaaacattattttttccactggcagtggtctgagaacataggccttctagtgcactaatattcttctcatcaccactagcaactcatcccttattcttacttgattgctgtctgtggtataaaagtaaggtgttactacatgagctttttgcagtagcaaagccagtatatttaatcatcaatgttgttctcaggctagtgtctttcattgtgtttatcaaagctacactgctgcctcctcaatccagagatatgggaaaccaactggatagaggggtgttgataccttactttgctgttttacaagcaaatcagaggactgtcttgaatggacccactagattggaagttccctgagaacatcttattttttcattttctctaatgtatctccagtatctatagaggtgtcagtatataatagatgtttaataaatagtttttaaataatgaatgattaattattaattattgaatcctaggctgggttgaggtggtctttattagtgacctgttggggtccacttttaggggcagcatcatgaactgcataacatctatctttgactgtcttggtattgcaggttcaaacttcataagttggtccaactcctatttcttctccctcctgagtggactcacagtgggtgtaagaattggcggacaatttgacatcaagagcttgaccttggtaggtgcttggagcctccagtcctctttccatagactttgatggcaggctttatttcttcaaaggctggatcttttctctttcaggtgatatgcagttaggaatttgtctcatgaattctagtcctgctctaaacagtggtcctcagtttctggactagtggagtggttctggctagatctgtgggctccttggtgtggggtccatgtggcaaggcctcacacacagggtagcaactccaacctcccaaccaaccttatgcattctcaatatttttgagacatatttgaatcatgacttgacactgtttctgtcccatggtggagcgctacccaagaatgtctccagttttgagtaacaagcagcttgtggtgatgaatcaaacaggacggctgtggttcctactttcagcaactgtgctgagctggagagtaatcagaactggttagagtatttctcacatcagactccttgagagcccttttctttactaaatttcagagattttagaaatcctgagttcttagactttgcagtaaaaataaataggcagtttgacgttttcaaaaggatatttttgattcaataaactcctaatgttttatctatatttatttatttttgcttgttgtacccagctccacacagagttctcccacattttcaatttgtaatttaattcatgtcctgtggtgttcctttggcttattctaagaactatatgaatggctttgatgaactgtttctctaagctagtatttcaacaatctgacagacagagagactcatctctaaggaggtaattcagcctagagggcggttaagtatcacacatccaaaacatgacagagaaaaatttttaaaaagttttattgaagttatgagtcacatagttgggctcttagctctgcagatttaaaaaaatcaaacaaaaataaaaacaaaacacgaagttaaacaggacaaaataaatgtaaagtagaaaatactaattgtttctaaagatctcttgaaaagtctccagggagggacaagtggcatcagcgaggatcacggacttattggctgggtcctgtgcagaactgttggacccacaatttccctgtttgtaaaatatggttattaagagcacctggcttatcgagttagaaaattaaatgagttcatagtagtcacttagggttttctagcacctaataagcaaataagtttttgatcttacaattattctaatttataagcctagcaatacttctcattttctctcttcctttatcttaatggtctcagtccacaccttccacattactacattccctaagctctcagctccatttctcccctgacccaggacttcttaagctttaattaattctactccctccaccttctctctctgaagatttaattgtgtatgtggagttatctgtttttcctgagaccagctttttcttttttcttttcttttctttcttttctttttgaaatggagtttcactcttgttgcccaggctggagtgcagtggtacaacaggctcactgcaacctctgcctcccaggttcaagcaattctcctgcctcagcctcctgagtagctgggattacaggcatctgccactatgccaagctattttttttttttgtatttttagtagagactaaccatataacatgtggtttcatcatgttggtcaggcagtctcaaactcctgacctcaggtaatccacttgcctcagcctcccaaagtgctaggattacagacagctgaggccatgtttttctttacccatcttttaattgtagtctaaaggttttcagccttgcaattattggacttcttggggcagataattctccactgtggggctgttctatgcttagtaggaggcttagctgcatccctggcctctacccactagatgccagaaattctctttctacctctaagttttgacaacaaaaaatgtcccttggagagtcaaatttacccctttagaagaaatgctaattctgcctatttttttgataattgcctgctacatcttcactgttttgtaatagagatgtcagaaacatctagtagctagctcctcctacgactggggagtccattatgagaggacaatcacatttcagtcattcttttctgacagttagaggcctcactacaacccctctcatcacatcctgtcccccactgccgcacaattccagcagaaaaggactcgacagattcctgaattttgcagacctagagctagaattctgcatcttccctgtggtggtgctggatgtcaggggcagacaggagggcacacttccagccccacctagggagagacagagtgaaatgccaagggagacaccagtggtaatgaggacaaggagctttattttttgatgaggtcaggcacaagcactgccaatccttcacaggtacaggggtaagggaacatgtgacatcctggacatcagacaggaagtgccttctggggagagctcagaccttccacaggaaaacccctagctcagcctgtgaaagccagaagagggtatctgggaactcatgcatcaagatggggttttcctgggcccttgggattcttgtttcctccaaaatcgcttgtctcagcatcaggatccaggtcagcagcagcctccagagccatggccgcagccagagcccccgccttgctgaccactgcccctgtcacaggagttgggcctctggcgccggcatcggtggtggcgcctgtggtggttcaggaagcagccgccctcggagctagggccacagcccccagagcttggggcacagccagaggaagctggaggcagacactgtactgggctctttgggggacacttgggtgagggacacttgggtgggggttggcactgctgctggttctgctggcaggacatcttggcaggagttgagttgtcctggacaaaacaaagccatttgttagtccaaaatctacagtccaatgtctctaagaccagcggcctcctgaggcaagagctgcaggaaggtgagggaagctgatgtggagttggtgggacatgccagatgcctctcactttgttctccaccagggacagattgctgtgagtctaagtgggcatccatgtttctgtttctccaaagagcctctaggaatgtacccttttgacaaaaggcattctggagaatggagatcataggaaacatgtgccagcctgagtagaaagaggatgggaaggaatcataagcttctgtggcctttgcaggtcatggaattgctgtcagttcctgcagggtctccctcctggccccagttcccacattggtaccctctctgccatcctctctccgggcttttgtttcagatctctccatttccctctcctgctatgaccttagttttctgttccaacatcccaagttgagtcccatcccctgctggacactcaccaggtgcagaggaggcaggagaaggctgttcctgaggagacggtggatgaggagcccagggcaggagtgcttttatcttgtgcacggtgtgtgatgcacagcctgggcatgctgctgctttcacaaccaggggaggtgtcaacaaggcacacgcccaagactaggtttgtagctttggcacttccataatatccaaccaatgacattgaacctggaagcaggatcactgtccacatacctctcacctgggaggctaccactgcttcttttcttcctcccttcttccttgtttcaactcacgtgctgtggagcacagtctgtcctttacaatttcctgggaattagtatgacataattctttcttgagtcatgactggagaaataatagtcatttcaacaaatagagatgaaataattggacgtccatatgtaaaagaaatcatacctaatgctagatataaaaattaatagatcataatttaaaaaattaaactatgaaacttctgcaataaaacataataaatctttgtgactttgggttatgcaaaatttttcagatatgccaaaaaggtacaattcaaaaaagaaatataggacttcatcaaaattaaaaacttctgcttttcaaaaggcactgctaggcaaatgcaaagaaaattcacagacttggagacaatattgtaaaacacaaatcttaccaaggacttggttcaagaattttttttttatttttattttttgagacggagtcttgctctgtcgtccagactgaagtgcagtggcgcgatcttggctcactgcaagctctgcctcccgggttctcgccattctccctgctcagcctcccaagcagctgggtctacaggcgcctgccaccacacccagctaatttttttgtatttttagtagagatggggtttcactgtgttagccaggatggtctctatctcctgacctgtgatccacccgcctcggcctcccaaagtggtgggattacagagccactgtgcccggccaatgttttttaaattctcaaaaataggtaataacacagaaaatatgggcaaagtatttgaagagtcattttaacaaagaagatatatgggtggcagttaagcacatgaaaagatactcaacctaatcagtcattagagaaatgcaatttaaaagcaaagtgagataccactctatacacattggaatggctaaaatgaaataaatgacaatatcaagtaatatgagggatgtagaacaacaagaagcccaagtcattgctggtagaaatgcaaaattacattagttggcagtctatcaaaaaaattaaacatacaacttacaatttgccccagaaatcctattcttagatatttagccaaaagaaatatagttgtatgttcacagaaaaacctgtagcccaacatttatagtggctttattcataactgccctgaatttgaagaaccccacaagatcttcaactgatgaatagagttttaaaaatggtatatttatgcaatggaaggctacttagcaataaaaaaggaatcaactactgatatataaaacaacagggatgaatctcaaatgcaaaagaagtcagactttacatactacatattatataattttaattatagggcattcttgaaaaggcaaaattataagaactgaaaataggtcagtggttgccaagggctggtatgagggagaggctgatttaataagcagatgagggaatattttgaggtgatagaactgttgtatgtcttagttgttgtggggtttacctgactatatatgttagttaaagctcatagaattggataattaaatggatgatattttggtatacaaaatctcaagaaatgaaacttaaaatagaaaaaacaattaaaataacaatttttagaaataaaaaataatgaaatataccaaaagggaagcaaagaatgatgaatacaagatttaggatcatggttatattagatgggacaggcagggacatgggtgaaggctgaattacacaggtgcatataatttactatcaaagttatcattttcgcttggatggtgaatttttgtgtgtttgttatttaaataatagacaaacaggtaggcacattaattaagaaggccaagcatggatgaattgtgagcatataatatgaacagagggtatttgttaatctaattttgtgcttctgaaatccaatagtaagaaaattaaatgacataaactccacgacaacttggacaacttcccaagttgccattgatggcttgctcatctcatcttccccaagaatgactcagctgcttttcatagcatcagtcatatattgcaaaggagaagggttgatccttggttggttgtttgtccactcatttattactaatatgacttctcagaagattcaccctggaactagacctcagataaagcacctcctggcccagagtcaacatgcttgttattaggtcataacatcctcattttgagccagtcaagtaaatttcttcttcattatcccaggtcctcaggatgtcagggatactaagaagttctcacagtgcagaacatttggagctgctccatgctctgagagaagtaactgggctgtggactgtgttctgagaagaacaagtggttggagatttcataagagatgtgtgagattaaggagttccatcccaagaagaaaaagaatgtctccaaattaggatatggagacagaaactcagaaagggacccagtggtggagctaagaaaaagccagctacaagtcagctttcaattcatgaggaaaggtggaccctcctgctgacaagttctgaaatgctttgagtcacactgacaggcggacatgtgttatactcaaaatgaagtcttacagcaattcaaagttgtacatcattaggagtaaatacggactctgtacttatttctggacaacgactgtacatggaaaagtaattattcacttctgaagctaggtttgaactccaagacaaagacagttctctcacccacactataatgcctacattttgcctttgggctcagtcatcacagatataaataccatatttgtgtagtgtctatcttctctgctaggttgtaagatccctgaagaaagtaaatgtgccccttattcagtgctgaaacccaagctgagcaagccacttactggccttagcagatattcagcttgtgtttctcaaataaaggatgatgagagtcaattccaacatgtaagattggtgatggcatgtcggaaagagagaggctcagatcaaactttgggcttgagaagaaaagttatagagtgatgtctccagtgagggttgcagatcaggggtcagggtagacccaacagggcatctgggactctctgggagcaccctctcactcctctcactcaggctgccccattcctgttctctaggttttaggtctgacaccactggcattttttccgatattttttttccactctcttggttgcttttcagcctcaccatccagtttgacataaaaaagcacattgcacctgttatgggacagtcactagaagagctaatggctgctctcagtgcagcagttaagctgaaaatgcaaatacacctagaaacccggaagggaatgaggatcttatgttgaagaccgagaggacttttgtatatggggtgagataagggtccagtttcattcttctgcatgtgaatatctagttttccccaaaccatttatttaagaaactatcctttttccattgtgtgttcttggcacctttgtcaaagatcagttaacaggaagtgtgtgtgtgggttaatttatgggctctctagctctctattctgttccattgatctatgtgtctgtcttttttttttcatgctgttttgattactggagctttgtagtacatttgaaatcaagtggtgtattacgtccagctttgttcttttgtccttaagattgctttggctattcagggtattttgtagttccacatgaattttaggatttaaaaaaaattctattttatttttcaagatggtatattggaggctttagcatgactcttccacttggaaatagcaaaataatgcataaagatcaaaattatggctttaattcaagaacgaaaatgggaattcactggaaagcaaaagacatcacagttcctaaggaggcgaaaatgggcaaacaacccttgttatagagtccagctgaaaagtgagtgaagccccaatatgtgagaggggcacacattatgacttagctttctaatggggatccatgcaacccaggccaaaggagagcatcatatttctcccatgccctggagctagcttgagaagaggttgggagacactgagagggaaagacactgggaaaagctgcggagattttcccgaacccagtactgaaagcaggatgccatttttaatccaggcacatacaaagtcagccattctctgatgacttggcagtatggctgtgcaggcattttagtcttgggccagagagtggagcacttaccctggagtagggtaggggtctctacagccataatctaatggcaagtgtggaaagtgccccacaagtaggtgctggaactgtgttctcccctatcaccgcagtaggagaactactgcagctgctgtttcttctgggtggtaagacttgcagccagggccacctggtgtggagacccggaattagtctgtatgtgtcattcatgggtgctccagcctgctcccctgagactgtgctgcagcagggcaatttctgctccatgctcccacagatcttcagacattcaggactccacttgtctggatcagcagcctgagctgccccattcttccagtgcagattgtggtaaagcagggccctctatgctttatgcctaggcagatattcaggcatctggagcacccactctcctggattaggagttcaagctgccccccaacacttccatgcagagaacttggggccaaggaggtttcccagctccaggcctaggcaccccactgggagcctttctcccttggtgctggtgcttgtgcctgccattggaggatctgttaggtgggctgcccagtgtggctctacccatctttgtatgcccccaaggactgagcagggagctcaaaccactgagcaccccacagatcagcccattgcctgaggcaattcagagcttctgtccgtaaacaagtatcaaatatatacctatttgcattgaccactgctggcttttactcataagcaccatctactggcctgtaggtcaaactgatcagcccaaaataaaacctgccaatagaagtgcctagggcatagggctacagaagtagtcaaaagaccctagccaacattttctacagtcacaccttctagggaggaagggggaaggaaaaaaaaaaaaagaacaaatcaataaaattatagggaaataaataaagaaaaaatcttatccacatgaaaatatttacatagaagtgctaggctagcatcaccagatgagaaagaactagcacaaggactctggtaccatgaaaagtctgaatgttgtgacacctccaaaagatcttcagcaatggtccctaaccaaaatgaaatctcaggaattacatataacaaattcaaaacatgaattgcaacaaagcacaatgagatcgaagacaaggttgaaaatcaacataaagaaacttctaaagcaatgcagaaaataaaggaagagataaaaaatcttaaatcaatcagagattctgaatttaaaaactcacttaaagaaattcaaaatatgattgaaagctttaccactagactagaccaagcagaagaaagaatttcactggtatgaataccaatcttttgaactaatccagtcagacaagaataaagaaaaaagaatttaaaaaacgaacaaagtctttgaggaaggatattctgtaaagcaaccaaacctacaaattactggcatttccaagaaagaaggagaaagagtaaacaacctggaaagtatatttgagggaataactcaaggaaattcccctcatcttgctaaagaggtagacattaagacacaagaaatatagagaatgtgtgcaagatactatacaaaacaaacatcaccaaggcagatagtcaccagactgtccaagattaatgctaaagaaaaaaatcttaaaggcagctagagaaaaaggtcagaccacatacaaagggaagcccatcaggctaactgcagagttctcagcagaaaacatacaaatcagaagacattgggggctcattttcagcatccttaaagaaaagaaattccaaccaagaatttaatcccctatcaaactatgcttcataagcaaagaagaaataaaatcttttccagaccaatgattactaagggaatttgttaccactagactaaccttacaagaaatctttaaaggagttctaaacatggaaacaaaagaacaatacctggtccacaaaaacacagttaagtacatagcttgcagaccccatgaagcagctacacaatagaaactacaaagcagccagctcacaacttcacaatcaaaacttcacatatcaatatgtgggcttgagtataaatggtctgcaggcccaatttaaatggcacagaatggcaggtaggatgaaaaagcaagacttatccatctgatgtcttcaagagacccatctcaaatgtagcgacaattataagctcaaaggggttggaaaaggatctatcatgcaaatggaaaacaaaacaaagtgggagtcaatattcttagataaaatagactttaaatcaacaaaaactaagagaaaaaccaaagaaggcaattacataaaaataatgcattcaattaaacaataagatttgactatcctaaatatatatgcattcaacattggggcactccagttcataaaacaagtacttctaggtatatgaaaagaacttagccacacaatgatagtgaggacttcaacactccattggcagtgttagacacatcatcgaggcagaaaactaacaaattctggacttaaattggacacttgatgaattgggttaacaaacttctacagagtacttcacccattaatcacaaaataaattcttctcacctgcacatggaacatactccaagattaaccacatgctcagccataaggtgagtctcaataaatttaaaaaaattgaaatcatacaatttatacttttggaccacagtggaataaaaacaaaagtcaatactaaggagatgtctcaaaaccaaacaattacatggaaattaaacagcttgtttctggatgaatttgggggaaacaacaaaattaaggcagacataaaaaattctttgaaataaatgaaaacagagataaaacatccaaaaagttaacaacctaacatcactcctagaggaactagggaaatgagaaaaattaacccaaagttagaagaaaagaaataactaaaatcagagcaaaactgaatgaaattaagatccaaaaccacacaacttcccaagactaaatcaggaagaaactgaaaacttgaccagaccaacatggagctccaaaatggaattagtaattaagaaaccgtaccaaccaaaaaaagccctagaccagatggattcatagctgaattctaccagaggtacaaagaatagctggtacccattctactaaaactattccaaaaaattgaggaggaaggactcctccctaactcattctatgagtccagcatcattctgatactaaaaatctgggaaagatagaatgaaaaagaaaaatataggtcaatatctcagatgaacagacacaaaaatcctcaacaaaatactagcaagctgaatccagcagcacaccagaaagttaattaaccacaatcgagtaggccttattcctggcatgtaggtttggttcaacatatgcaaatcaatataagtgattcacctcataaacagaattaaaaacaaaaaccttatgattgtctcaatagtgcagaaaaatcttttgataaaatctaacatcctgtcataaaaaccctccacaaactaggcattgaaggaacatacctcaaaataataagagccatttatgacgaactcacaatcaacatcatacagaatgtgtagaatctggaagcattccccttaagaacatgaagacaaataggctccttctcaccactcctattaaatctagtagtggaaattctagtcagagcaatcaggcaaaagaaagaaataaaagacatccaaataggaaaagagtaagtcaaattatctcttttctctgattctgtacctagaaaaccctaaagactctgccctaagtttcctagaactgataagcaacttcagtaaagtttcaggatacaaaatcaacacacaaaaataagtagcacttctactcaccaattacgttcaaactaagagccaaataaagaatgcaatccatttacaatagacccccaaaaatacctaggcatacatctaaccaagatggtgaaagatctctataaggaagactaaaaatcactactgaaagaaatcgtagatgacacaaacaaatcggaaaacattccatgctcttggattggaagaatcaatgtcgttataatgaccatatcgcctgaaacaatctacagattcaacactattcctatcaaactaccaatataatttttcatggaattttgataaaaactactctatattcaatatggaaccaaaaatgagccaaaatagccaaggcaattctaagcaaaaagaacaaatttggaagcatcatattacccaacttaaaccatactgtaaggccactaaccaaaacagcatggtactggtacaaaaacagacatatagaccaaaagaacagacagattacctagaaataaagcaatacctctatagccagctgatttttgacaaagtcaacaaaaataagcaatagggaaaggattccctattcaataaattatgctgggataactggctatccatatgtggaagaatgaatctggacccctaccattcatcatatacaaaaattaactcaaggtgaattaaaaatgtaaatgtaagacctcaaactataaaaattctggaagaaagccaaagaaatacaattctgaacatcagccttggcaaagaatttatgattaagtccccaaaggcaattgcaacaacaagaaaagtcaagtgggacctaattaaactaaagagcttctgcacagcaaatgaaaccatcgcagagtaaacagacaacctacagaataggagaaaatattcataaactatgcatacaacacagttctaatatccagaatctttaaggaatttaaacaattcgacaggcaaaaaaaccccacaaataaccccattaaaaagtgggcaaaggacatgaacagacacttctcaaaagaaggcatataagcggccaataaacatactcaatatcactaatcatcagagaaatgcaaatcaaaaccacatgagatactgtctcacaccagttagaatggctattattaaaaagtcaaaaaataacagatattggcaaggttgtgcagaaaaggaaatgcttgtacactgctggtgggaatgtaaattagttcagccactgtggaaagcggtttggagatttctcagagaacttaaaacagaaatgctattcgacctggcaatctcattactgggtatatatccaaaggaaaataaactgttctaccaataataatagtaataataataacctatacactcttaaattcatcacagcacaattcacaatagcaaagacatggaatcagcctagatgcccatcaacagtggattggaaaattataacgtggtacatatacaccatggaatattacacagccatagaaaagaatgaaatcacgtcttttgcagcagtgtagatccaactggatgccattatcctaagaaaattaatgcaggaacagaaaaccaaatacttcatgttctcacttataagtgggagctaaatactggatacacataaacataatgatggcaacaatagacactagacaactagaaggggagagaggaaaggatgcaaggagtggaaaactactattgggtatatgctcactacctgagtgatgggatcatttgtacccaaaccttaacattgtgtaacatactaatataaacaatctgctcgtgtacacctgaatctaaaataaaagttgaaactgtaaaaacaacatcaaaaaattctgtcagaatgtcattggaattttgatagacattgcagtaaatctgtagattgctttggggaatatggacaatttattcatttatttattttaatgtatattatttttaattgacaaactagaattgtattacatttattgagtacaatgtaatgttttgacattttgtgtagtgatatatttgaaatttgctctctctattttgaactaagccatacataattattgactgtattcactctcctgtgcgatagatcttaaaacatatccctgctgtctagctaaaaattttaagtttttgattaacaaatccccaagtcctttgctgccctctccctctagcctctgttaactaccattatactgtctgcttctatgaattcagctatttttagattctataaataagtgagatcatgcattgtctttccatatctggcttatttcacttagtgtaatgtcctttaggttcatccatgttgtcacaaatgacgggatttccttattttataaggctgagtagtagtctattgtgtacgtatactacattttctttctccattgatagacacaggtttattccatatcttagatactgtaattaatgctgtaataaatatgggaatgtagatatccctttgatacaacgatttcaatgccttggatatattttcagaagtaagattgctgaatcatattttagttctatttttagttttttcaggaacatccatatcattttgtataatgtttattataatttacattcccaccaacagtgtacaagtgttcccttttctctgcattctcaccaacacttttcttttctttttttctttttttagatatataagccattctaacaggtgtgagttgttatcttactgtggttttaatttgcattttcctgataattagtgatgctgagttttttttttttcctaaacccgttggtcatccctaggtctttgtttgagaagtgtctgttaaagttctttccccatgttcaaattttttttcttgctactgagttgagttcattacatattttggatattaaccctttatcagatatatggtttgcaaattttttttccactctgtgggttgtctgttcactttgttaattggttctttggctgtgcagaaggtttttagtttaactaacaaaagcaatccaatttttctatttttgctttcgttgcctgagctttcagggtcatattcaaaaaattattgccccgagcaatgtcatggagctttccccctatgttttcttctaatagttttaaagtttcaggtattatgtttatgtctttaatccattttgagtttatttttgtgtatgctgcaaaataaaggtctaatttcacttttatgcatgataaccagttttcccagcactacttattgaagagactgtcctttacccattgtgtgttcttggtacctttgtcaaaagtcaatcgactgtgaacgcttaggtttattccctggctttctactaaattgttccatttgtctatgtgtctgtttttatgcaagcactgtgctgtttttactactgtagctttgtagtagatttcaaaaataggtcaggtgatatccccagctttgttatttttgttcaagattgccttgaactgtttgtggtcttttgtgctttcacgtgaatttaaagattatttttggcctggcgtggtggctcacacctgtaatcccagcactttgggaggccgagacgggcggatcacgaggtcaggcgatcgagaccatcgtggctaacacggtgaaaccccgtctctactaaacatacgaaaaaattagctgggcgtagtggcgggcgcctgtagtcccagctactcgggatgctgaggcaggagaatggcgtgaaacctggaggcggagcttgcagtgagccgagatcgcgccactgcactccagcctgggcgacagagcgagactccgtctcaaaaaaaaaaaaaaaaaaaaaagtttttttttctatttctgtgaaaatggcaatggaattttgatgtaagttgtattgcatctacagatcacttcgagtaatatgaacattttaacaatgttaactttttcaaaccatgaacatatttttatatgtgttttcttaaatttatttgattagtgttttaatagtctttagtatacacgtttttcacctccttagttaaatttacacctaagtattttattttctttttttgctgatgtaagtgggattgtttccttagttttctgcttggataactcattattagtgtatagaacactacttattttcatatgttgattttgtgtcctgcaactttactgaatttatcagttctaacaagtttttggtggactctttagaattttctttatatgagattatattgtcagcaaatagaaacactttcattaattccttttgtcttaggattccttttatttctttctcttgcctagttgctctggttaggacttccagaactatgttgtaaagaattgtgagagtgggcctccttcttttattcctaatcttagagaaaaagctttcaacttttcatgattaagtacgatgtttgctataggtttgtcagatatggcttttattgttttgaggtacatttcctttatacctattctattgagagtttttatcatgaaaggatattgagttttgtcatatgctttttctgcatctaatgagttgattacatggtttttattcttcattttattagtggaatgagtcacatatattcatttgtattttttgaaccatcctcgcagccctgggtaaatcccatttgatcagggcagatgattcgtttaacatgcggttgcatttggtttgctagcagtttggtaaggatttttgcgtttaggtttatcaaaggcattggcctgcaattttcttttctcggagtgtccttgtctggatttggtatcagagtaatgttggtcttgtaaaatgagtttgaaagtattccttcttcttcaatattttggaagagtttcagaaggattggtatacaatcttctttaagagattggtagaatttatttctaaagccacccagtcctgggcgtttctttgataggagactgttactgatttaatcccttatttattgctgatttaatccctttactcactattggtctgttaaggttttctattcatgagtcagttttgttaggttctatgtgtttaggaatttataaatttcttctagatatccaattatctggcctacagttgttataatcatttgtatttctgtggcatcagttataatgtgtccactttcatttctgatttttatttctttgagccttctttctttttttcttagttagtctagctaaggtttgttgattttgtttatctttaaaaaaataattatttgtttcattaattttttctactgttttcctaggctctattttatttatttctgcttggatctttgtcattcctttccttctcttaactttgggcttagtttgttcttctttttctagttccttgagatgtaacattacattgtttatttgagatcttttgtctttttgatatagacatttattgttattattttccctcttagcactgcttttgctgcatcccacaaaatttgttttgttgtgttttcatttttgtttatctcaaggcattttttgattttctttttttatttcttctgtgacccattggtttttaagagcatcttgcttgattttcacatattttaaaattttataaggtttctcctgttacagatttctagtttgatgtcattggttggttggtatagttttaatcttccgagatttgttaagaattgttttgtggcctaacatacagtctattttagagaatattctatgtgctcctgagaagaaagtatattctgttgctgtttggtggaatgttttgtatgtgtctgttagttctctttggtctgaggtgtaattcaagcctagtgttcccttattaactttctgcttagatgagctgtctattgttgaaagtagagtattgagatttcctgttgttatggtattgcagtctatcattcccttcagaaaatttaataattgcattggtatatatgtgctcttatgttgggtgcatatatatttacaattatattcttttgatggcttagcactttctattgccgtaaaatgacctactctgtcttttttatagtttttgacttaaagtatattttatatgctataagtatagctaccatgctctctttgtttccatttttatgaagtatcttttcccatcccttcatgttcagtctatgtatgtccttagaaggaaagtgagtctcttgtaggcagcatatggtttgatctttaaaaaaatctattgagctcctctgtcttttgattagataacttaatcctgttacagtcaagacaatttttgatagtttaaacttactaccattattttcttaattgttttctggttgttttcttgatcttttgtttctttcttaatttcttgttctcttcctttgtggcttatagttttctgtggtggtcttctttgatttttttttatattttgttctacaggattttgctttatggctaccatggggcttatataaaacatcctaaatttgaaacaggctattttaagctaataactttaattacaaacagaactgcacattaattccctccttccccttgtatacttttgatatttacctagttttataatttatatctcttaattatttattgtagctacagttatttttaatagttctttttttaatcctcataggacagataaaattgttttatgcttcacccttacagttttagaatattctgaatatgattacatagtcatattacttataccattgagatatttacttttgtgtttttgttattaattagcagattttcattttagcttgaagaactccctttagcaattcctatggagcaggcctagtgatgatgaattcccttagcttttgtttgtctgagaaagtttttatttctgcctaatttctgaagagcagactttccaggtaatgtatccttggttagcacttttttcttcagaattttgaatatctcattctactttctcatggcctgcagaatttctgccaggaaagctgttaacagctgtattgggactgctttgaatgtgatgtttcttatctcttggtgttttttttttgtcttgcatttttgataattttattctagaattttttgataattttattctagaattaatgtttgggttgaatttacttggagacttatgagcttcctatacctgaatgctgtcatctttcttcagattttgaaaatttttagtcattattaccttaaatgtgctttctgggcctttgtctctctcttcttcttcttcagaaactcctattatgtggaggttaattctcttaatagtgtcccataatttctgtaggtcttttccattcttttttctttttactcctctaactggataatttcaaatatcctatcttcaagttattctttcttccacttgatcaagtctgctgttgaagctttctattgaattttatagttctgttattacatactttatctctaggatttctatttttattgtttctatttatttggcaatctcctcattttgttttataaattgttttccacatttaatttagttttttatctgtatttacttgtagtcccctataagtaatacgactatgtatcatattcagaatattctaaagctgtaacagtgaagtataaaaaagctttatctttcctgtgaagattaaaaagacacaactattaaaaataactgtaggtacaataaattattaacggatacattttacaaaactaggtgaattttttttttttttttttgagatagagtcttgctccgtcacccaggctggagtgcagtggaatgatctcggctcactgcaacctctgtctcccaggctcaagcaattctcctgcctcaacctcccaaatagctgggactacaggtgcatgctgccacacacgactaattttttgttttttagtagagacggggtttcaccgcgtttaagataattgttctgaattcttcatcagtcattttataaatcttcacttcttcaggatcccttattggagatttattaatttccttatgatgatgatgtattttttcagatttttcataatccttgtgtccttgcattggtgcccaaccatttgaggaaatggccaactattccgcctttgtttgtgttatttggccatggtataccttcactatttgatcaaacctggaattctgattaagcaagttggtggtgaccttgaacgggaagaccttgctgtcatgctctctagctgggctgaactgttaactgtactggttgagtagaatttctggctctgttccatggtctggtgagagaactggctggactctgtaataagacagagctgctggctgaaattgcctctgattgagcagtattgttggttgtcttccttagatggccagtactacagttttgaatatgtagttgggcaaggccatgttttaggtgtcaaggctgaacaaagactctgagattgctacctaaccatgcagggtgacaggaccagaggctgtgctccacagatacacatgggcatgggttcagctctaatcctgggatgacctaaggcagagcaccatggcttgatatattagccacttggatgctgggcctgggtggaacagatgctccttctacagttaattgccaccatgcccctgttttctggccttaggaagcgttaaggagcacaaagggcagggcttgactgggtgaaagcttggcagctgggaatggttggggccagatgttctctttgcaggtaattgccattctacccttatctcctggcctggggaagtttcaaggggagcactggggctgagtgtggaagctgagcagagattcaaacctggcagactaatcaactgtgcttcttgttgagcattgcaagcctctctggtggtgtgcctctgctggccagaatgcagagcaactatcaagacccctgaactggtcactgtgagtctcaccctgttctgagtttctaaataaacattgctaatgtttcctgtgggataagacaagagagtttcttctgcgaaggattccaaaatggtgggaaagctgaatgttcattctcaactctctcttccctctgtaaaagccatgggttctgggaatcctcttatgtgtgatgtgctggcttgagggagggacagtgtggtcaaagtaaaacctcctcttgctctacgtgtgtggtttttctcagtactgtggtccaaggggatgtctgtgcctcacttcaagttctgagatattcacaagggtatccttgtctgctgttggttgctagttggatttctgtggtgggactactggagtcagagaattcctattctattatatttctaacatctcccctagtatgaacattttagcaacattcacttttccagtctgtgaacatgtaatatctttctatttgtgtcttcattttctttcctcaatgttttatagtttttagtatacagatctttcacttctttggtaaaatttattcctaagtattttttggatgatattataaatgggatttttaacttctttttttggatagttgttatggtatgtgtaagtgctactgatttctgtacgttgattttgtattaaagtcttaaacataagacctgaaattttaaaactactggagtaaaacacagggggaaaacttcttgacattagacctgggcaaatattatttttgaattttgaccctaaaagtacaggcaacaaaataaaaaatagacaaatgtggttgcatcaaagtaaaaagcttctgcaaaataaagcaaacagttaatggagtgaagagacaacatacagtatgtgataaaatatctgtgaactacacatctgataaggagttaatattcaaaatattttagaaactcaaacaactcagtagcaagaaaacacataaaccaatcaaaaaagtgggcacagggagtttcccaaaagaagccatacaaatggcctacagtatatataaaaatgtgctcaacatcgctaataatcagggaaatgcaagttaaaaacacaatatcacctcacatctgctagaatggctattatcaaaagacaagaaataacaagtattggcaaagatttggagaaaagggaacctttttacagtattagtgggaaagtaaagtagtatggccattgtggaaaacagtgtgaagtttccttaaaaaattaaaaatgaaactactatgtgattcaacaatcccactactgggtatatagctaaaggaaatgaaatcagtattttgaagagatatctgcactcccaaatttattgcagcattgtttactacagtcaagatatagaatcaacctaagtgtcctttagtgggtaaatggattaaaaaacatgttatataagtgtaatggaatacaactcagccttatataaaaagggaagtttctaatttgtgacaacatgtataaacctgaaagatattatgctaagtaaaataagccagatatagaaagacaaatattcgtgatctcacttttatgtggaatcctaaaaagtcgagtgcgtggaagtagaaatgatcattatcaggggttgggttggggagtggggaagaactggggagatgttggtcaaaggatacaaaatttcaataagaccggagtaataaattcaggagatttattgtacagcatgatgactataacaatgtattgtatttttgaaaatttctaaaagagtagactttgagtggtcttattacaaaaaatggtaagtgtgtccagctgtcattcctggagaacacctgaaaaccatcaccctttgggaccatcagtgcaatagaggactgacttacaaaggctgtggtcttaggcttgaagtctttttaaacacttctgtgatagtgcttattctgtcagatcaaatatatttacttttctgagtgatagtccatttaggctgtaaggtgctcaatggaagaaatatgtccgatacatctccatactactactgttgaaagaagtaaaacgaacagagcttggaatgaacaagcagaggtgggcaggaggtacagggtggaccagagtgggaagtacttctgcagtcacgaggacatcctgcttccatcttattaaatctttaggcatgtgcccaggaagacacaggggtcatcttattacacctttaggcacatgctgaggcagcaggcaactgggaagtgtctggtgctgtcacctccctggttgtgaaaacagcagcatactcaggttgtgcatcatcgtgtacactgcacgggataaaagggctcctaccctgggcttctcatccacagcatccttaggagcagccttcttctcctacctcctctgcatctggtgagtggccagcaggggacagatcctcagctgggagtgtttgggaaagagaggcccagaactgaaatggaaccatcagaaagaagcccacagtgggcagcagtgggggaggtgatggagaataaggagcctctaaagcacatgtcagggacccgtgagctgcaaaacccgcaggaccttaggattccttcacattcttgtttggagcatgttgtcaggaatgcacatagatccattttatatttttaaggttgctttatccaaatgcatgtgtagggttccctctactacattcccatttctctcctacagatcttggcttagaaagtggcttcatcaagggggtcagtgtgtgacaaacccaaaaataaggagatggtctgagggttctgtgctcaaatgtttctattattctgttcaaggtaaaattcctgcattcctgcaaagatgtcctgccagcaaaaccagcagcagtgccagccccctcccagttgtccctcacccaagtgtcccccaaagagcccagcacagtgtctgcctccaccctcttctgactgtgctctaagctccgggggctgtggccccagttctgaaagtggctgctgcctgagccaccacaggcacttcaggtcccatcaatgccggcgccagagatccaactcctgtgacaggggcagtggtcagcaaggcgggggctcctgccgtggccatggctctgggggctgctgctgacctggatcctgatgatgagacaagtgatctttggaggaaacaaggatcccaaaggcccaggaaaagctccatcctgatgcatgcttttccagataccttgttctggctttcacaagctgagctgggggtgttcctgttgagtatccaagctgtccccagaaggtgcttcctgtctggtgtataggatctcacagttccctcatccctgcccctgccaaggattggcagttccctgtgcctaaccctgccaaaaaataaagcttcttgttctcattaccacggtgtctcacttgttaggaaactatccaggatttatccatccaggccaggttctcctgtcacccgaactcgcaggaccttagaaagccagagatttaagtgtgttacccctggtagaggtgaccccagagagctgacctcatgctcgggcaagtaactgggctgtgttctcccagccaaccctctgtcatcacaggacacctgctcagcctcagacctgtgtagtttttgctctgatgacaaacagaggagcgaggaattgggagcccctcatggaggggaggaaaggttgatgggcaccatcaccaggatgggtatggagcctcccaagccaggcatcagggttggggctgtggagaaactcatttgtggacatctgctgcattccataggaacagaaagggccccccattacagttctggggtgttctgaaacttcagaacttactcctctgttgttgtatcccaatgactacagattttactcctaagaagcaaaagtggtcactcagctatattcagccccacaatctggctaccatgagaaagtgcttggtctatctcttttaaatgtctctttgcaggacagaggccactgaagggacccttaacattaagagtaaagtggccacccaagagtagttcaagggataattcctgaaaatacttccaagacagagacaggggtcatgtgctggaggcaggaaaatgctgctgagaatatcaatacctaaacctaccctctccccagtccacattcagagccaccctctttcctacggcccagtgcctttatgctcccacaggcatcactatttcagtttgctagggtgggctgtcaggcagaataagaagacaaaaattataaccccaatagtgaacataatttaatttttgttgacaattataatttaatttaaatatgtataaagtttgattacagcctgactgatttatcttgaaaaatatctagaaaaaggtacttattttaatattagagattaattgaatgagaaatttatctacaattaaaatgaaattcgcagagaaaatagcattcagtttgcatcaattctccgtacccaaaatatagacatgatcaggtcagctccattacatgagatgcacccagcactaccatcaacctcaaaagcagcaacacataccaaagtcatcttcatcaagcccatccattatcatgcatgcttgcagaacttcatttcgagtccaagcagatgaacgactcctccctctgtgttttcatggtcttcaaataaagagcacacattccctggattttgatggaaggtcatgccttttgtaatgtgcttactgtgactcttggcactccaattgttgtactttccttctccatatttgcccctcaatcaggtattcatttggctcccctcctctcctgcccaggggcctatgttacctcctgggtaccagtgaggctctttcaagagtcctcatctccgctgactttacccttccatctgttttacacacagcccattctgaatgtccagcatccttacctcagtcaccaccccaacagcaagtgctgatcacatctgatgcttgattttcctaagggaacattacagaaaaaagtagatgggcaaagaaccatggacttcgtgggtagtcatttacattgcagtacttatctcatggaagcagtctccctatttacttgactgcctgtgcagttagacagttaatttctataggtcaggtgatgtgtcatattgaactctaccttccaccacaatgcatggagcatgacatattttaagcacacatgtaggcctgggtggaaggtgtacaagtgaggaccagggcttcctgtgtcaaacatgccaccctgttcctgggaagacggtgaaggcctggacctgggctgggttgtttggtgctgtcacctccccgagcaacccattcatgctgcccctcacaatctagcagctctgtcttgggcttcccagaccatggacttctttcgaataagctttctcttgctgccatgaaaccagatggatgtctagctggagacaggacctgagctggaagacctaggaagacaagcccgggtttcttccatcaggggagaaggaagcagagggtatgggatggaggaagcaggaagagtgtggggttaatgggcaccctcccgggatgtatcaggtgtcctgtgactgcgaaggtcatgggtcttcagcacaccctcatcttcttcctatatatgttctgagagatgcactgatctcaccagacatcatcaaggaagctttacccaaacaggtttattctcctctgtgattacatgaagataggacacctcagctgctcaattagaaaagacccagtatcattttgtagcaggtgaccaaagagaaaagaacatctttccaggataaactaactccaaatttattttcatttcctccctatatttcttttcttttcttttctttttttttgagacggagtctcgctctgtcacccaggctggagtgcagtggcgtgatctcggctcactgccagctctgcctcccaggttcacgccattctcctgcctcagcctcccgagtagctgggactacaggtgcccgccaccacgctgtactaattttttgtatttttagtagagacggggtttcaccatattagccaggatggactcgatctcctgacctggtgatccgcctgcctcggcctcccaaagtgctgggattacaggcgtgagccatggcccctggtcctcctccctatatttcttagtgcagaagtacacccatcagagaagagatattacaaagattcatttgcattattgcattctctctagagtcattgatgctttctgagattttgtgtcagcaaaacgcgcagcagggatagcctccaaaggctcccagagttccccacccagtctgagccccatgtctagtctaccttcagtcttctcctgctatggctccagctccaggggttgctttaactcttagggggcagctgcagcctgggctaccacaggtgctatctcttccactggcacaggcactagagacatgactgctgtgagtttacccactggcagctgcagctgttgccagagctttgggcactgctgctgacctgggcagtgcattgagataagcagttttagaggaatcagagacccaaagtgcccaggattaacctcagtctgatgtacctgctcctaacctcctgcccatggtcggagctcctgagttcatcctgacaagggttgtcagtgatctccagtggtctccctggtgtccctcatggttgtctccacatccatgttctggtcagtgcttagcagcacttatgtctcactctgtaaaaaataaagctttcctttctcacctacgtttctatattgcccctccgaaggctgctccattgctctcccatgccttatctcccagactgaatgcttcacaggatgagaggaatgagagacaacacttctctctactcatagggagaccatgagttgctgctaggaagaggctacagaaggccacatggctgcagggaggaaagttcaccttatttctatatggaagatctgggtgttgaggaggtaggaagggatccttgaaagctgaatagttgatgggtgcaaggagagaaatgtagatggttgcagaggtatacactgagaggaacttagaagaagtaagaaaataaaaacctgatcattgcaggagttgtaaactggatatattcatagggtcaatgatttgtatactactcatgatgtgccagtggcttgacatacagtaaataatttaatcctcactgcagtccttcaagttacgtacaacccttgtcccattttacagatgggaatcatcatggaatgagtgtccagggtctcccaacagctgccatgcaaaccttggcagttttgctgagaagcctatgctcctgatgactgtggtgttctaagttcttctaaaatgttttaagagatgtgagtaaacaatggatttgttttgtaattattttagtccacagtattttgttgtttgaattatacatcactaaaccaccaaaccatatgaatcacacttttaaggagttcgcctcccagagtttggacccagagtgtagtattcagctgcaccacaggattaaaatcattatttttgatgtgcattaaaacaacaattcactttcactaccaattttgagaatgttaatgaactggagaaagactcagtaaaaattcaagccttggtgctcatcagtaaaatactagcaatccaaggaggtctcataaactctgagccaaagtgaaagagcagatcttaagagtagtttagggctagatacaacagagaaattaatgtatccagtaataggtgaatatattaaattttagaagctttttttccaagctcttgggaaatagggaaaagaaaattactcccctcttctgtgttcatagacattcattttcttaactcattgggatgaaaaaggtacccaaagggatcctatgaggaagttgatgtcagaactgctctgatgagtttagatcgactgcccagctcaattcctcttagttgccatgcctgggtttattgcccttggatggatacaggctccacatcttactcatcccatcaaccatcccaggtgacagcaggtgacaccatctggattcatcatttactctggctggattcatcatttactgattcaactagctaagaaagatttgtttaagaagttaccacagctgtaggacttataaaagcctatgatacagacttttgattcactacgacaaccacttgctactcaaaaattgagaaactcttgaataaaatcagcccaggcgacataaagaatgttgtgttatgacttctagaccaagtccaacacccaatcattcataatttatctgctcaacacgtagttttgtggcactggtctaggtgtttagatcagtgtgaaacaagatgaagtcccctttcaggcagcttatgttccagtgggcccattggagacatcttctggtttcctggcttgtcagcagatttagacaaagatggttctatattcagttggattcccactctggggcacttgacagatgccggtaaagggtggctaaacccagtgaaggcacccatcatgggcaaacttttgaaaactggatatcattttttgggtgaatacaaaaaggacatccaatgtctggttgtttccacatcaaaggtaggagcttagtgagtcaaggggtaggtgggtgattccaatggtgaaatgtttgtttaaaagttgaaaagtccttgtcccttcccagtgcctttctcacttcccagttctcagtgaacaaccccattcacccaagtatcttgaaagtgcttctgtttggtacttagctataatgtatggagcaaataaaaaaaatggccacacctatacccttccctgtatcaggatactcagacacatttaatgcaataataatgttttattaaaaccttgtcgttttaggatatgtttgaaacttacatgtgtattccatttttacatacttttaatatatcatgattcaggataaaatatatatctattattataataaatgcattggaaaaatactatagagtttagtgctctctctacaaccttggtccatgttgtgtcaggtgctcacggtgatcatattaacctcattataatcatacccatcaattatcatttctatttggacaaatctcttttagtcatcccatccaatttgaatcactctcttccctgggtctcttagaatcaatagtacagtcgctaagatcctgacacaaggttccttaaatgtatgttaatccatgatgcatattaccaaagccattgtggatttcttatacttgtctctgaatttacctgtgatatccctgggtcattttgcctccatgtaaacagatttgttttgcctcagacatctttaccttaatacagctattaggagaagcagggaaagattaaaacctagaagttcctgtctccaaaatggatgctcttaatgagcaaattattctgcattcaagactgtacatgtccccagtattcccctcagccctgttctacctcgacctcagcattgtctctttctcctgggcacctccttgatgtttcttgggtccacaaatttctcttagttgccatgcctcggtttactgcccttggatggatacaggctccacttctcattcatcccatcaacaatcccaagtgacagcaggtgacaccttttggattcatcatttattcagagtcgctacagaaccaaaagggactaatgccccaaaaccctgacttcaggcctggggactcccacacactgtatcccagcaccctctcctggctcaggcttagtttcctacttatctgtcagtctcactacaccatcagcctaagggtagggatggtatcttcttcagtcttgaatctgctttgcccagcacagtgagtgtcaccatctcaatataacttgtttaaagaaggaatgatgttaatgaatgaaaaatgaagaattgcagacctacagaaagactgaggcacaggtatgtgaatagtcacggggtttcttgaatccccactctcctcaaaactcttgacacctgccatggagatacagaggtcttggggctacagaggcaaagaagctgactcctaaacgagactcacattctcacccctcccaatcccaacacccatttcttgcctgcaaaagaaaatagaaaaagagctctaaggtttgctcagtcctcactggaatcaggatgcctcaacccaagttactttctatttcctgcactcctctgctcgggaatttttcctaagttgtggattcaaagccacatatgctttgaaataaacataaaaagatccaatttttgatcctgtttgagccatcacaggctttacacatcccacaaggcacagcatcagccctctggatgctgtcactcatgcagtgaccagggcactgaaaaccacagtggagcagggctggatgatccagtgaagcaaagagagaagcctcttcccagtgtggtgattttcctcctccctcacctctgctcctccttggtggagaagtcccgtggaacattagtgaagataataagggtgggaatgcccttgtagaaattactgttaatagtctgagaattgggcaggtactataaatcctaatcttttgtgtttcaaagccatttgcatcaacaagtgtttggtttcgaactcagcgtatccttgtcttagtaatcccttcttaggtcttattaccagaaagatcctcactcaacagaatgcccaggtgcagttccagtcagaacactcttgtggtgcccactcccaattttctctgtcaaacgtcattgagctctttcaatgcttcctttcacttttcccccaaccactctgctgcagttttgcatcccacagtgaacaagcttgtgtccattccaagccccctggagatgagacctccctcagagccaaagtatattcattgagcagagtatctgtcactaaagtgatgcagctgcctgggacctagcacagacccttcatgcccctaatatgtccattcctctccctacattcaggataggcagaatgttgaaagaaaacatggtaaaagataactgtagcaaagaattggcaaaagagatggcaggtgttgaagaaacggaatttgtcaagggtcatattggtcagggtcttctattgcctcccagagagttttcctttttccccatggactacaggtaagtagcacatgaatattctcaccatccaacacccaactccctgtcctccctcttgatcttctaagatactcctgttcatgaaagacttcctccctgaccttccaaactccatcatgtctccagtaactacccagtttctacttccagttgcctttacagtacctgtgtgtggtcattatgaagcttccaccaacattcctgaacttgcttctcgtttgtccttggggacctgaaatctgggcatttattgatttgattgatgctagaaagggtgggagaatccaaaactgcccctttcttataaaaacctaagagcctactaagttgtgtattgaacagtctaaagtcagtacaataaaaacatgaagcattgtctttttcggtcattgttttttcctatgctctgttgaatctctcttgaaaatacctcagggaaattccacatttcgtcagtcacttctatggatactaaagtccagaccagctaaatttaattctgaacaaaatttgaaactcaaattctcccttgcacacaagcattgtccaggtatctcccaggagactggagttggaaggggaatatgatgggctctttctctcattcactaccacccctccaccttcttcctcagtagcccttcctcctccattgtattgggagatggaaaaggggagggagaatcattacacatgtgactgtaccactagcctcctctgttggcaggttctgcggcagggctgtctctgcttcttctgtgtggcaggttctgcaggagggctgtcttatagggtgcttttgtgagtcctggagtatcttcaagcattttcctaacagcatgatttccagacatgggatgagcagtcggatttaacccttcacgtactccctaagctcctaccttcgttggcaccagccatggcttctcgataatgaggtctgtctgcccaacagaaaaccatcctaagcacaacactagcaagactgtggaagctggtcttccttcttagatgtcatctgctgttatgtctcaatgtcctgttctatctcttcagttccttttctttattcaacaataggctcagaggttagaacatcaagtctactactacagcagacattctgctgggggataaaaatgctgtctttctttcttgaaggaatctctaacatctacaggctgtcattgtgaatcctgccctttcaattgacctctgttgtaggagaacaaccagtttccctcccatgtacaagattagggggagactacatcattgtcttttaggataataactttcctatctaaaaaattctcaccaaagttcaaccttccaaatatatagctgaaccagagaaatagagttctatttttttttcttagcaagtcttgcagagattttcagcagcttatcctaagtttactttagtatatggggataagaggcatctactattttcatcttttgacttcagccaacatcgtaatacaagaagaaaatttgagtccaacatcttcttacacactgggtcctaccagagctttctcaggagaatagagcggtgtaaatatctcaaaatactatttaatctgagggaaaaattcaaatccatataagaaacttaggcacgttggaggtatatggcactttctggccactgcttcccattttccttaagaataacttagctgcttgccatggaatttgattgtcgcagacatggcaggaacagaatggagaaggaactgtgagttttaagcaaagggagaagaattctgtttgttgactcatccttgattgctgatgtggaatgtccaaaatgcactccaaggggctaaatctgaggtcctgcagtgcctgttcctatagtaccaattggaatgactaagtcatgaaatttttcctggattcatccagccagagcagtctctgtatttccttgatgtctttgggccacaggaagccaaggctcctcaggatgggactctcaggactagtgattctcagggaggtgcccttgtgctgtaggggaagtgacaagatcatgatcttatagctactgtttgtcatcacgggacaaatcctgtgcgtgtgagaactgtggacacctgatttcaggaagaggagagtggtgacaggagcaatcactaaggtagaagggagattaatgagctctccaggtcttgtggggaggctttcaagacaggcagtcaagaatggggctggaggaaagcctaacagtcatctattgtgttttataaaacagcggtaacacgatatattgaatgtcataggcaaggattttttttcctttgaaacttgcccaaaatgtgtgatttatgtttctttctcaattaacgcttccatctcctacctccctcagctgccaatgactcagggttgcaacccatgcaggaaaatggctatcatgcttgctctgttgggaggacaagacttgcttatgataaatacaagatacagagaaataaacgttcagatttgcagcaaagtctaaaccccagtaattttttaactgaatttttcaacagattgtgtccctcttcaacttcaccagtatggaatgagaaagtacccatttcaaccatcatgagtaattccttccaatgcactagcaatttgtgtgttctaaagaatgcaaaagaaatggacacctagtgtagtcccggggctaagcccaaaaatatcccttcagcaagaggcttctgcaggcagaagaatatcagagaggggagtcaatgacaggtctgatccttttcctcttcctccattcccaagccacattcctagagacaattcactttctcttaaatatctcaaaataaatcatggaattctgccccccacctcccaccatgttttaaagagggtaagttgtaaagtgcatactctgataaggagtttgttgtctaaaagccataaactatcaagtacagggagcaataacaggcatttaccataaacatgtgttatttaaaattaccatttaacttaaatttaatgttctgttatagttctgactttaactttttagaaacaaatagcaaagttcaggtattataataatagagatgaattcagtgaaaaattcatgtctaaaactattatacaatcaaatgggaaaaatacaaatcagactttatatgtcatcctacagaaaccttagaatttataaggtttgttccattaaatttgatgcacatgatgttactaccatcactaacctcatcatcaacaatacattgaacgaatcatgttcatgactcacaccaactatcttacatattttatgctcatggaccattttatttgcttataatcagtatcatatatcccatgggaagctaaatatgggcaaattgacctttttcatattaagtatgagtcttgtgatctcaactattgtatattccttaatgattttgtctgcttattcatataatcctaccttaattctcttaagggccccaacagccccagacagggcttgtgtcccattctccattcattacctaatacatctcactcccagggtccaatagtctcagatcacccaacatccccaagagtcaggagccaattacatctcaacaaaccatgcccctggggaatatgcagaggaatagggaagtgatgtccaaaaaaagacatcctgggatacccaggacgaatcacatgatatcatatcagacacataagtttacatctctgatgttagtccagttaactttgaaaggctcaaggtcaggaaatgtgtcatatgcatctttacattctccctcaaagtgcaagaggcagagctcaaactaaagcatccaaactgaatgagtgaaaggagaagaaatgacaggtccccaacacacgtggagatctgtcatcaagacttcctggttccctcttgccaggcatcttggcaagcatgaagcaagatgctggaggcctgggatgggagtgtttggctctgccacctccccttgttgtgaaagcagcatgcctggtctgtgcatctctaaccctgcacaagataaaaagcctcttatcttgggctcctcatccacagcctcctagagaacagccttctcctcttcagcatcttctgtatctggcaagtatctagcaggggaccctcagctgggggtgtctggggaagataagcccagattttactagggaagggggaagcagaggtgtcagatgtacagacagcaggaagaggacttcagagggcagctgagggtaggggaaggggcagtgagcaaggaacctctttggggtgcatgggagtctgtgactcaccagagccctggctctcagcattctctccactcttttcctgggagatgcatacatgcccagtgatattctctgagaatcattactcaattaggtgcttttgcatcagtgtttttgtgaagacaggaggacttgggacccagttagaagacaccagcattcttttctggaagagggaaaaatggaaggaaatgtcttaccaggccagttttacttgagatcagtttctgtttttattcctgaagtgcatatctcaggaagcaactggtattaggagtaagggcttcataaaaccatttgtagaggagacattagcctggagcttttgcgttgaccttttccttttatctatccaggctgtcacctcctgccaagatgtcctgccagcagaaccagcagcagtgccagcctctgcccaagtgcccctcacccaagtgccccccaaagagctcagcacagtgtctgcctccagcctcctcctgctgtgctccaagacctgggtgctgtggtggccccagctctgagggcggctgctgcctgagccaccacaggtgctgcaggtcccaccgatgccggcgccagagctccaactcctgtgacagaggcagtggtcagcaagatggtgcctccgactgtggctatggctctggaggctgctgctgacctaattcctgatgctgagacaagcgactttagaggaaacaagtatctcaaggaaaaaggaaaagccccaacttgttagatcctttcttagacatgctaattaaccattcattcatggggaagaattgtgctttttccaaaaggctccacccatgtgttttccaagatcgtggaagcctcctttcctcctgacaatgttatcacttgtgtctgattatacagagaaataaagcttctgaacagcacctgcatctaacttgtctttcactctgctccacagaaggctgctcagtgggtctcccctccctcagctcctgaaggtctagcacaccctgcatagagaataatactggcttgtggctggaaaattaaacgttcatatttttcttcatgcagggagtccctgtgggagatttgagtatagaagtgtaggagaaaggggaggtgttgagagaggttggtgaaaatctcttaaaaaaggcctaagatcagagcagaactgaaggaaatagagacacaaaaaacccttcaaaaaatcaatgaatccaggagctggtttttagaaaagatcaacaaaattggtagaccgctagcaagactaataaagaagaaaagagagaagaatcaaatagacacaataaaaaatgataaaggggatatcaccacagatcccacagaaatacaaactaccatcagagaatactataaacacctctacacaaataaactagaaaatctagaagaaatggatgaatttctggacacatacaccctcccaagactaaaccaggaagaagttgaatctctgaatagaccaataacagactctaaaattgaggcaataattaatagcttaccaacccaaaaaagtccaggaccagaaggattcacagccaaattctaccagaggtacaaggaggagctggtaccattccttctgaaactattccaatcaatagaaaaagagggaatcctccctaactcattttatgaggccagcatcatcctgataccaaagtctggcagagacacaacaacaacaacaaaaaagagaattttagaccaatatccctgatgaacatcgatgcaaaaatcctcaataaaatactggcaaaccaaacccagcagcacatcaaaaagcttatccaccatgatcaagtgggcttcatccctgggatgcaaggctggttcaacacacacaaatcaacaaacataatccagcatataaacagaaccaatgacaaaaaccatatgattatctcaatagatgcagaaaaggcctttgacaaaattcaacaatacttcatgctaaaaactctcaataaattaggtatcgatgggacgtatctcaaaataatctaagagctatctatgacaaacccacagccaatatcataccgaatgggcaaaaactggaagcattccctttgaaaactggcacaagacagagatgccctctctcaccactcctattcaacatagtgttggaagttctggccagggtaatcaggcaggagaaggaaataaagtgtattcaattagcaaaagagggagtcaaattgtccctgtttgcagatgacatgattgtatatctagaaaaccccattgtctcagcccaaaatctccttaagctgataggcaacttcagcaaagtctcaggatacaaaatcaatgtgcaaaaatcacaagcattcttatacaccaataacagacaaacacagagccaaatcatgagtgaactctcattcacaattgcttcgaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgtcatacccatcaagctaccaatgcctttcttcacagaattggaaaaaactactttaaaattcatatggaaccaaaaaagagccctcattgccaagtcaatcctaagccaaaagaacaaagctggaggcatcacgctacctgacttcaaactctactataaggctacagtaaccaaaacagcatggtactggtaccaaaacagaaatatagaccaatggaacagaacagagccctcagaaataatgctgcatatctacagctgtcagatctttgacaaacctgacaaaaacaagaaatggggaaaggattcccaaaactgctagccatatgtagaaagctgaaactggataccttccttataccttatacaaaaattaattcaagatggattaaagacttaaatcttaaacctaaaactataaaaaccctagaagaaaacctaggcaataccattcaggacataggcatgggcaaggacttcatgtctaaaacaccaaaagcaatggcaacaaaagccaaaattgacaaatggaatctaattaaactaaagtgcttctgcacagcaaaagaaactaccatcagagtgaacaggcaacctatagactggtagaaaatttttgcaatctactcatctgacaaagggctaatatccagaatctacaatgaactcaaacaaatttacaagaaaaaagcaaacaaccccatcaaaaagtgggcgaaggatatgaacagacacttctcaaaagaagacatttatgcagccaaaagacacatgaaaaaatgctcaacatcactggccatcagagaaatgtaaatcaaaaccacaatgagataccatctcacaccagttagaatggcaatcattaaaaagtcaggaaacaacaggtgctggagaggatgtggagaaatgggaacacttttacaatgttggtgggactgtaccattgtggaagtcagtgtggcgattcctcaggaatctagaactagaaataccatttgacccagccatcccattactgggtatatacccaaaggattataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctctgtagggacatggatgaagctggaaaccatcattctcagcaaactatcgcaaggacaaaaaaccaaacactgcatgttctcactcataggtgcgaattgaacaatgaggacacatggacacaggaaggggaacatcacacaccagggcctgttgtggggtgggggtaggggggagggatagcattacgagatatacctaatgttaaatgacgagttaatgggtgcacaccaacatggcacatgtatacatatgtaacaaacctgcatgttgtgcacatgtaccctaaaacttaaagtataattaaaaaaaataaaggcctgacttttcttggatgataccgtgggaggagtgatttgaccctgtagcccacagtttccattgacggtgatgtagagaatcagaaaatcgacaagaatgagaccaaagtggatggagcatgtggaggcagaaagaaaggtctgaaggatgaagatcaagtcaagctgcacataatggaccttagggagggaggttagctgaagtcagtggattctgaagcaattggaattgaagttttctctgacgggaatgctaatgagaggctctgtgctctgagaaaacagaaaaaagcggacatgatgaatgcttctgggggtacagattacatatctgtaaatttcttttaagatatttgagatagaattgaactcattattattttctgtcgtgtgttactttttgaactcaacaataatgagacacagccatattctagttaccactggactctaactgggcagctcctgccccaacattggaatatggcagtgttttatctctactccaaaccaaagtgattgatgtgaatcatcagtgctgcttcattttgatagctggattttggaaataatgttgcaaaactggggactgttcaacccaagctatgatggttcttgagataacttcagaaagatgaaaacaaatcatatagctgtggctacagtcaaagcagaaacttttgagagaaattagaggttgagcttggacattttagacagagaataagacctatatgatactttgggaattcaactgattataatactttttttaatttcatttttaaaaagtggcaaactggaaaaatcagttttgctccaatatatgtggacacattatttcttaagaaactggaatgaaaagtgtcaaaaggaaccataactgaaagttgaagtcaaatctgctctgctagtcaaatcacttaactggctgagaagggttctctgagaaagtgaacagagatttgaagcttacaattgagtagacttgaatcaatgtaataggcttcttgctctggtacacttaagacatgcttgggaagtactttttaaaagtcagaattaaaacacataatggagaaaaaaggaaaaggatgggcaagctccttatgggaacacctgagtcccacattcagctaagttgtacatgcaaagccacaagcattgatgaagctagttggcctaaaattcacaggaattgtgtgcatttcagggtgcatagagactgagattgcacaaacatttgatgagtgttggggtgatcagacccaacaccaggctgggggggggctacgaagtccggtggagtcaaaggaatgagaaaagaccagttaagaaataaagtgggaccagggggccaatgctagtatggagactgcaaaggccccgagctctgggagcccatgctatttatttgtgatcaaagaaacaggtggtgaggatgtgggggttgaaaggaagcaatgtattaagtgaatgagctacagctgtgatggtttagcattttctttgaaacatatggctacttgcaataatgggaatgctagaagcgaggagccagcaagtctagacacattccagaggccacaagggggttttagatcctggaacccagacatgttccaagccctgactcagcttgtctcccaacactcagcttttctcccaacaatgagtgtatctcccatgccaggtgccactctaggcattgtagatacaatgggaacagatgaagtttctttttacttggagcagacatcgactgggcatgttgcaggctgacattttccttgctctgcattcagttggattatcataccctgtgtgtcatgagtgtcagtgtaggtgagataaaccttggaaaaacattaaggcatgaaagtggtgaattttggggggactaagaaagctatctagtggctattggcacctcagcagagccaacaactttagaaggaagaacataagttgctgatggcagaaaatcagtgggtgtcctattgttacataacaaatcaccccaaaacttagtgatgtgaaacaatacactaagtgattggaatgacagccatcttggttttctcacaattttatgggtcacaaattcagaaaggactcagcagggcaattctcatttcatgcatttgtcgtcagatgttgattggagctgtggtcatctgaaggctgactgggctggacatccaagaagtctcactcagatggttggctgttgatgctggatgccagctgagccctcttctggggttgtcacctggaggacctacatctggcctctcttgcatgatggtcttagaatagcgagactttttacatggtaactggcttccccagagacagcctcctaagaggaccaggtggaatctgcatgaccttttgtgacccagcctttgaagtcacatagcatatttcaaccatattcatttggttaaaggagttacaagcccgcttagattcaaggtaagtggacataggcctaacttctcaatgagaggaatgtcaaaaaaaatttgaaccatgctttaaaatcatcacaaataggtatcagccaaatcctcaccctcttgtcagttcactctacatgttgctgaagccctagtataaattaatgttcccacagtgttttgaaaagactcagattttggtcatgcttgtaacatattcaagctttgaagagggtggccactcctataacctttatggaactagaatgttcagaactattgctgcaataatgatgtcttaccaaaatatatcaaagttatttacatatgccagataattatctaattcctggccaacatggtgaaaccccatctctactaaaaatacaaaaattaaccaggcgtggtggctcgtggtagtttcagctactcaggaggctgaggcaggagaatcacttgaacctgggaggttgcagtgagcagatatcatgccactgcactccagccctggagacagagtgagactccacctaaaaaaaattaaatgcaatgggaaaatagtatacatctgtcatttatattcagcagaaacactggtgaaataaacttaattaccactattgtccatcactttattttttctcccatcaattatcattcaatccctcctttttcctaaagcgttctggccaatgtgatatgagcatccctgtgtctgaaccattcctatctcttggatcaatagtgcagtcaagtaaatgctgaagcaatgtctgtcatgtcacagatctagactgctagatttgcaagtctgtcatgtcacagatctagactgctaattggtggctcagcttttaattccagcatttctggttcattttgcctttattttttagctttgttttcccctagactcttcaaggtttctcctggtatttaaaagaggggaggcaatgggaatgtccgactccagtgcccatgttcttggcctgcacactattctgcctcccattatcttagcttgcttccctttcagatccaacttctctcaaagggcagcttcatttcctccctctgccaggaaaccttctgcccagggactcctggctcttgggtcccattagttcctcttagtcactttagctaggccatcacaggaccatcaaaggtcattttgcaggccagaaacctcacccaacacccacaaatgatactagtgacaatgtctggacacttcactcttgtcagggaaacagggggttaccatccaaaggataagtcccatggacttcccacacacttatgtaacagtccatatcattccagctcataagtggattgctgacttgtcagtcggcatctcaaggatgggaatcatatttcacacatttctgagtcctttgtgtcaacatatatctgaactgtgtcctcaattcctgttgtttgaatgaattaattaatgaataaaatagtatagacaattagttttcaacagtcttgataatcaaggccagatatttgggtgttacagggacttcctggttcccttctatcagaaaacatctgggcatctactgaataattattgaatttcctactgaggggctagagtttgaagagctgttacttggagtagagtccatcactatcatcactctccatgtcccatctcctttttttctgattctaaatcaaagtaggaggagaaaataccttgatcagcaaacattctgagccaattcatccctgcccaaggccctgtttccctgctgcccttaggttagcaaaaacgtgagcttagggtcatagggtcagggtctgagaaagacggtgagggacaaggggagacagataggtagatagagatagatagatagatagatagatagatagatagatagatagatagatagatagaaaacaatgatttactttttcatttcttccagggatcactgagctgagatgtcctgaaaggaaaaactaacagcactgtcagccccctcccaagtgcctaaccctcaagtatccttttggttgtttgctgccagtctatttctgttgtggttccagctctgcaggaagctgctaccggagtcaccatgggcccacagatcccactgacatgcccaacagagcattctggaggctccagttgctgccacagctctgggggctgctgtggtcctgggtcatgaagactacagagtatcagagttggaggaaccagaggaccaaggacctgctcccatctggagcttctcttcttctctgccatctagggctgagctaccaaagtgttttcggaaggatctgaacgggcccagtaagctcattccctttgttttccagagctctgtgtttatttccaactcatgcttctgtccttgaccttgtgaaagactgctcacctcattcccacactaatatacaacccccctaaaagggttttgtgagttgaggggtgtatgacccacttgtgtctgttcctaagataggcctatgtacccaatgtggggcagcccctgtaaggcaaagacgggaacgcactggacagagcttgcaacgagaaagcacagctttattcttcacagcacagggatattaaagaaggagggaaaacactaagaccagcaggataaatcccctgggggagtacttgaaactcatcaaggaacatctcagtaggaaagaggagacaggagcaaagaagcaccaggctagggctggttccagtcattttggcactttcttttctcaaatatttttacttaatctcgtggctcaggtcagcagcagcccgcagaactgtggccacagctggagctcccgccttgctgaccacttcccctgtcacaggagttggagctctggcaacggcaacggtgagacctgcggcatctgtggtgactcaggcagcagctgcgctcggagctgggcccacagcccccagagcttggggcacagctggaggaagctggaggcagacactgtgctgggctctttgcagggcacttgggcggaggctggcactgctgctggttctgctggcaggacatctaggcaggaggtcagggagcctgggcaaaataaaagcaaagcaaaatacgtgtcaatgcaggtttcaggccagggcctcctcatgctttggtttaattgtggatcccttcccctaaactcagtctgccctccagctaagacctggggaaggggaatgcaaacggatctgaagttaaaccggcctgatactgccccttcctccggccctctcccctgcctgggaggcagctgacactcctgggtgggcctctggggctcctgcgcacgccctgcggggcctgtcacacctccggacccgatgcgaacagctccccctgcaggcgtcccgtgaacacaacgcccatgaccctccagggtggcgtctctctggacgcctgtgagcgcagggtgtgaggaggcaacgcatctctgcgcacatgaggaaaagggggttcagaggtcgcagcatcgcggagcccctgaagtggctcgcagacttgtctgtcttcctcactatcccgcccatctcccatcccagtcccagccggccacccaccacagcctctctgccgcctccaccgtgtctgcctcctcccctctccttgttgaagcacagacgtgtttgcgcagccctttcagcccaggtcctctcgccagctggacgctcacctggtttggtggaggcaggagaaggttcttcctgaggtgattgtggactgaggaacccagggcctcagcccttttatcctgggtattatgatgcacagcccaactatgtgtcctcctttgctccccaaagggaggggaagcaccacacactcccaaggaccaggctttcagcatattcttaaggcgcatattttgaggaatgacaaaagggaagcaggaaatctcgatgacggtccaattatccaccgttcaggccctctggctgctgttccacttttttttcttcattcagctcacatgctctgaagccagggtacgtcctttgtggggcctggtaatatggggacaaacagaacacatttctccccttgactagctcacagcttttcagaaggccagatggacaactgagcaattaaatcacatcctatgtgctaagcgacgcagcacaagtgtgcacaaacatggcaggctggggtcactgcctttgggtgtcagtccccattgctttgtggattcctttacataggtgatggaatcagcccctgtgtcctgagatgttggctgcactgagctcactggacctgggttgagtaaggggtggaagaatggagctggggccatggcttgagaggtagtgtcttcagggaatatcatggcatcttaaaggtggcattgggcactgtgggggcagaggggtagagtggagggaggtgcagatggtataaaaatgtgacctccatctgtgggatcaacagaaatcacacttaatgggaaaaaaggggcatccgtttttggctgtctgtgaaatgtgcaaggctgaatttaatcctatatattatgttagtaattcattaaaatttctttgaatttgttgataatgatgaggttgatggggttgtatgcatttcacttaatgaatacctgtgataatgcttgaagtttgtatatgatgaattcataaaaatggaatattatttactatttggttttagttatatcagtgataaatttatcagtgaattcatctctaataatacaatacaatatgccatagcctctaaataaaaaccactgtaatgaattttaaaataatctttattatactatatattcttccaaggaaaataatcacaattgagacaatattaagtttctaataatcatgaatttaaattatattgtaattttaagcaaaatgttattttgatcagagtatatgaaagcctgaagatgcttgttctttggtacaaaatacactgctagaggatattagttccttcttcccctttgcctatcactccactttgaacaaactgcaataccatgcattcttttaagagttctatgaggtcaggagttcaagaccagcctgttcaacacggcaaaaccccgtctctactaaaaatacaaaaattagctgggtgtggtggtgggcatctgtaatcctagctactcgggaggctgaggcaggagaatcgcttgagctggggaggcagaggttgcaatgagctgagatcgcgcaactgcactccagcttgggtgacagagcaagactgtctcaaaaaaaaaaaatagttctgcagaattatgaatggaagagtgggaattcctggtggaaagctggtgaaaggctaggacaggtgtgccagaagcatgtttttaggaacatgctgaatggggtcctcaaggctttgttaagttttagtgtcagagctatgctggaagtaactttgcccttatatccttaagtactcctacttccttccctcagaggatataataataaaaagagacaattgcaaaggatgtgaatgggcacttttgaaatgccacactgggtgttgtgaatgagaagagcgtaaaggaaacatagatctcttcgcactgctgcactgactttgctggtggaatgggtgtgagagaaggacaggaggggatcaccttgagggaagcatgctgttagtgaaatctgggcctcctgcagacttaatccttgtctgaaccaaatgccttttccagacacagcccaaaaggttgaggagaatgggctgtgataccttcagagcagggaaagtacttatctcttgaattgttggttcacctaatgctcttcttctgagactgccaggcccagatcagcagcagtcctactgacctgtggcagcaacggaagctcccaccactgaccactgcaataccatgaccataggtagtaacactggtgggatcagctcaggcatctgagctgctcctagagctggagccatggtgagatgagcctggaagaggacttggagctggtcaaaggtagtcactttagaacgcacttggtgaattacttaggagtgaagcacttgataggtgtttggtatggctgatggctttattggcagcttatctcagcaggatctatttagcacctattcagatgcatcaaataataataaaaaatgtttccttttgaaattaaaatcacattttgtagacaatatataggtaaaataaacaagtttcagaaagaaaattttttacccagattaatttctttaagatttctttttctctagataagtatagataggtagccatatacatgtattcatagatatacatggcccgggccaagctctcggctacttgcagaaactcagccaagggaggttgaatagtggctgggctgagagtcactttgccttggcctttaaggctatacaattccagggccggttccttctctgtctggacgtctctttattctccaatctctttccttttttttttcttgttccatcattttcaccttttcttctaagacttatgaatcctgccacagtgaaacttccctagtttcagacaagaactcctacctgtggaggcagactggaggaaaggcttgtgatgaagctccctttcctgggagatccagggctgggctctgaggtgtgatatggctatcggtggagcaggtcaagcctcttacacttgcagggcaggtaaaggctcttcctggcatcctgtgcttgctcattcctcctgtggtggccccatggaaactcccaagtggttgctttttgttgccaatgaggagatgaagttttgccaaggaacaccctttcctcaggcttagtccccactgagcagcctggggattcccaagaagcccgtcattggattagagattatatgactccaggtatccatgtgtctgtcccttcttaggaaacatctagtcacaccctctcctttaacttatttgaaagagggcaggaggaagggagatcagttgctggccaggggactgacagaacagaatggatttgtagaaaagcatattcaagacttagtgactcattgtctgtgcaagatggaggatatgaattagccaagattatgttattaactctcctaatgattaggagcatagaaagctttctttagagaattttgaggttgaggtcacagaaggaccttgaagtggatatagcttcaggatgtttgaagaaatgggggtggaggcttatgatctactggtcaagaaagtcctggagggaaacttctgaatcacactctgattattttcttgtattctcctccttccttccatccctccctctttacctctattcttttcttctttcttcctccttccctccctcccttcctcttccctcccttcctttgcaccactaaccaagaaccaatttggtctatgagaccaaacaaagccagtgaatatcacacatgatgtttctgttgtcactgcagccccaatcagctaagagtggtgggtgggtacaaaagtatctaaaactttaaaccactgatatgaagattcatggaagcagtgaccaccttgtcaacagtgttcctagtagcacagtgttcctagtagttcccagtttatggtacaacagtgattgtccctgggcattatgggacacatggctagagacttttcatccttctgctctgagcacacccatctacacacattcaccacatatccatacacataatgatgctccattatgactattcctgtcaaacggaatgagggaaccacagaagacatcaccaaggccatttttagatgattcagtgtcttgactatctcattggaaaacagtaattcaaacttcaaacctgtgcaagtgtcccttccttcctttgttctttccttccttccttcatttttttcttccctccccctttccttctttctttctttttcttttctaattattataagatggttttcaaatattccactgaactttgaacaacttggggagatccttatgttatcatctttgaatttctaagcaatgatgaactgagaattgtctttatggaaggtgtttaattaatctttgctgaattaaactcacagctctgagaggatagcggccatatctgggaacagaaaatcagtgagaacttggagactgaaaaaagaagagtcacagaggccaagggcttggctaatgtcaggaattcccatggcacatgctcttgctcttggcccgtgtctggcttctgacagctaagtacccttgccccactaacatgctctgttctgcttatgactactgtatttccatgctccccagatgagactcaaggctcagcagggatttggatctcagggctgagcatgtcccctccacctcatcaaagagcctcctccttgctctgtgcttgggcaatgctgtggggaatccagcctagaatagaataaggggatctgacgagatatcctgttctggcccaggagtggggccaagggggagcatctgtagtgagccgaggaacctcctcattgggatattcacagggacctagcaggtgagagacagagaggcctaaggaggctgaaatcttatttgaggctctgggagaggagccttaaagaaatcatgtaatctgaaccccctcaggaaaagtgtggatgcctgaagatgtcaagaccctgtttcttcagagttccctcacatgaacacaggaatagactgcttctttgttccatttcctaggagtggggtcttacggattcaacttgatgagaaaataagtgttagagaaagagttgcctggatgtaactgagcaatttctggatgctttctcaaccatatgaggaaatctatggagtgagattggacttccctgagaacatctgtcttctgtagctgatgtgggtcatagttgagctgactgcatattaaaggcatggggaggggaaggagttaggggtgaagggtgtggggaagagctagataggatctgaggcaaatatgtgggggtgggctttctctattaccttctgtaaatttactctctataaattacttaatttcccaatgcctcaatttccttatccataaaatagggattaagctgatggtatggaatataagtatcaattaatgatataataagcaagacaatggggagaggtggagcaaggtagtcaaatagaagcctccagcaatttcccccctgcaagaacaccaaattgaacaactatccacacaagaaaccagcttcatatgaaccaaaaattaggtgagcgatcagagtacctggttttcacatcatgtcaaggaaaaaggcactgaacaggataggaaacacagtcttgaactgctgacaccacttcttcctcatcccatggcagcagctacatggcatggtgagagatagtgtgtgcttcaaagaaagagagtgcagtgattgtgggactttgcattgaaactcagcgctgccttgtcacagtaaaaagaagcatggggtagaattcagctaatgcccatggagagaccatttagaccagccccagccagagaggaattgcccatgccaggagttgaaatctgagttctggctagccccatcaccatggactaagtattctgggattctaaataaacttgaaaggcagtctaggccacaaggacataaattcctgagcaagtcctggtgctctgctgggctcggagccagtggacttggggtgcacatgacctagtgagacaccagccagggcagccaagggagtgcttgtcttacttcttccccaaccctaggcagcacagcttactgccctgggaaagactccttcctgacacttgaggagaggacagaagagagtaaagagtacttagccttgcaacttggatagcagctcagccacagtataatagggcaccatgcagtggcctaaggcccccattccctgccctagctcccagttgacaattctagacacagcctgggccagaaaggaacccactgccttgaaggaaaggacccagtcctggcaggattcatcacctgctgactaaagagcccttgggccttgaataatcatccgtggtaaccagacagttttcacctcaggttttgggtaagacccagggctgtgctggcttcaggggtgacccagtgccttctcagctgtggtggctatgggagaagactctttctgctttaggaaaggagaggaaagagtaaagggaactttgtcctgcagcttgggcactggctcgaccacagtgggataagcaccaagcaggctcccagggtccctgattccagatcttggctcctggacagcatttctggacctaccctgggccagagaggagcccattgccctggagggagagacccaggcctggcagcatttaccacaagctgactgaaaagcccttggtccttgagtgaacatcagtggtagccaggcagtactcactgggggcctggattggcggtggccataaggagaggctctttctgcataaggaaaagaataaaaagagtgggaaggactttagtggctttggtgccagctatccacagcaaaatagaggaccaagtagcttcctaagattcccaactctagtctctggctcctgcatggcattctggggcctgccctgggctggggtacagctcactgccctgaagcgtaggacacaagcccagttggattcaccacatgcttactgaagagcccttgggccttgagtgaacatcatcagtagccaggcaatggtcactgaaggccttgggtaagacccagtgctgtgctgaacttgagtctgacccagcacagtcccagtggtggtgaccgcagtggtgcttgtgtcactcctcccatagctccaggcatctcagcacagagagattctgtttgtcttggggaaagtgaaagaaagagaacaagcgtctctgcctggtaatcggaattttcgtaaatcttacccaagaccaccaaaacggtacctctacgactctgcaaaagtcacagcattatggggcttggggtaccccctaatgcagatactgctgcagtgactaaagatttagatcacaacacacaattatctttgaaaatttggaaactttcccaaggacagggcgatgtcctgtctgtcttcaaaagcccagactgcaaagtctacaaaaaatacctaactcttcggtgatcagacgtgaataaacatccacaagcgttaaaaccatccaggaaaatatgacctcaagacatgaattaaagaaggcaccagtgaccagtcctggagtgacagcgatatgtgacctttcacaccgagaattcaaaatacctgttttgaggaagctcaacaaaattcaagataacacagagaaggaattcagaatcctatcagataaatttaacaaagagattgaactaattttaaaaatcaagcagaaattccagagctgaaaaactcaattggcttactgaaaaatgcatcagagtctctcaacagcagaatcagtaaagcagaagaaagaattagtgagcttgaagatgggctgtttgaaaatacacagtcagagagacaaaaaaaaaaaaataaaaatgaatgaagcatgcctacaagatctacaaaacagcctcaaaagggaaaatctaaggtttattggccttaaaaaggaagagagagagagagaaagagagagagaggagagaagagaagagagattgggatagaaagcttattcaaagaggtaatacaaagaactttccaaacctaccccaagcaatctactgattcagtgcaatctttatgaaaataccattgacattcctcacaaaaatggaaaagacaatcctaaaatttatgtgaaaccacacaaaacccagagtagccaaatccatcctgaggagaaaaacaaaacaaaacaaaaacctgagagaaccaagaggaaaccaatcccaaagctatcagaagacaagaaataatcagaatcagagctaaactgaaggcaatcaagacacacacaaaaaaaccattcaaaagatcaacaaattcagcagttggttttttgaaaaaaattaataaaatagatagacaactagctagactaataaagaagaaaagagagaagatccaaataaacacaatcagaaacaacaggggaggttaccactgaccctacagaaatataaacacccatcagaggctacaatgaacacctctatgcacacaaactagaaaacctggaagagatggataaattcttggacacatacagtctcctaagactgaaccaggaagaatggattccatgaacagactaatgatgaattccaaaattgaataagtaataagcaggctaccaaccaaaaaaaaaaaaaaaagaaagcccaggaccaggtggattcacagctgaatcctaccagaagtacaaagaagagctggtagtatacctactgaaactgttccaaaatattgaggaggagggatgactccccaactcattctgtgaggccagcatcatcctgataccaaaaaacctggcagaggcacaacaaaagagaaaaatgcaggccaataaccttgataaacattggtgcgaaaattctcaacaaaatacttacaaatcaagtgtcaaactacaaatgacattcttcacgaactagaaaaaactattttaaaatttaaatggaaccaaaaaagagcccaaatacccaaggcaatgctaagcaaaaataacaaagctggaggtatcacattacccaatttcaaactgtactacaaagctacagtaatcaaaacagcatattaccggtacaaaaccagacacatagaaaaatggaacagagtagagagcccaggaataaggctgcacacctatagccatctgatcttcaataaaattgacagaaataagcaatggggaaagtactatctattcaataaattgtgctaattgtctaatcataaacagaagacagaaactggaccccttccttacaccatatacaaaattcaactcaagatggatgaaagacttacgtgtaaaatctaaaactataaaaaccttggaagacgacttaggcaataacattctagacataggaatgggcaaagatttcatgataaagatgccaaaaataatcacaacaaaagcaaaaattgacaaatgggatctaattaaatttaagagcttctgaacaggaaaagaaactataacagagtaaacagacaacctacaaaatgggagaaaatttttgcaaattaagcatctgacaaagatctaatatccagcatctataagaaacttaaacaaatttacaagaaaaaagcaaccccattaaaaagtgggcaaagtaaatgaacagacacttttcaaaaaattacatacatgtagccagcaatcatattaaaaaaaagttcagtatcattgaccattacagaaacacaaatcaaaaccacaatgagatgtcatctcacaccagtcagaatggctactattaaaaagccaaaaaataacagatactggcaaagttgtggagaaaaaaaaatgcttatactctgttatgggagtgtgagttagtttaaccattgcggataacagtgcagtaattcctaaaagagctaaaaacagaactaccattcaacatagccatcccattactgggtatatacccaaaggaatataaattgttctaccataaagatacatgcacacatatgttcattgcagcactattcataatagcaaagacatggattcaacctaaatgcccatcaatgacagattgggtaaagaaaatgtggtacatatacaccatggaatacaatgcagctataagaaataatgagattatgtcttttgcaggaacataaacaaagctggagaccattatccttagcaaactaatgcaggaacagaaaaccaaatatcacacattctcacttataagtgtgagctaagtgatgagaacacaaggaggggaacaacagacactggggcttacttgaggttggagggtgggaggagggagaggatcagaaaaagtaactattgggtgctaggcttagtaccatggtgatgaaataatctgtacaataaacccctatggcatgagtttacctacataaaaaaactgcacatatacccctgaacccaaaataaaagataaaaattaaaaaactagaggaatcatattacctgacttcaaattatactacagagctatagtaaccaaaaccgtatggtattggcataaaaacagacatatagaccaatggaatcaaatagaaaatccagaaataaattcatatatctccagtaaactcatttttgactaaggtgctaagaatatacattgaggaaaggacagtctcttcaataagtggtgctgcaaaaactggatatccatatgcagaagaatgaaactcaacctatctatggccatataaaaaatcaaatcaaaatggactaagacttgatggacttagacctcaaaatatgaaactactataaggaaacattggggaaactctctaggatgttgatctgggcaaagatttcttaagtaatatcccaaagcacaggcaacaaaagcaaaatggacaaattggatcacatcaaattaaaaagcttctgcacagcaaaggaacaatcaatgaagtgaagagacaacccacagaatgggagaatatatttgcaaactatccatctgacaagagattagtaacaacaatatataaggaactcaaaaaactgtatagggaaaaagtctaataatctgattttatttcatttatttattttctattttggggatagagtcttgctctgtcacccaggttggagtgcagtggcatgatctcagctcattgcaaactctgcctcccagttcaagtgattctcctgcctcagcctccccagtagctgggattacaggcccaagccaacacacacagctaatgtttgtatttttagtagagatggggtttcgccatattggccaggctggtctcaaactcctgacctcagatggtccacctgcctttgtctcccaaagtgctaggattacaggagtgagccaccatgcctggcctaataacccgtttttaaaattgggcaaaagacatgaatagacatttatcaaaagcagatacacaaatgtcaaacaggcatatgaaacggtactcatcggcgcttgttagagaaatgcaaattaaaactgcaatgagatataatctcaccccagtaaaaatgacttttatccaaaagacaggcaataatgaatgctggagaggatgtggagaaaagggaacactactggtgggaatgtaaactcgtacagccactatggagaacagtatggaggctcctcaaaaaactagatataactaccatatgatccagcaatcccactgcttggtatttctccaaaggaaatgaaatcagcatgccgaagagatatcggtgcttttatgtttattgcagtactaatcacaatagccaaaatttggaagcaacctaagtgtccatcaacagatgaatggataaagaaaatatggtacatatatacaagggagtattattcagccataaaaagaatgagatcctgtcatttgcaacaacatggatggaactggaagacattatgttaagtgaaataagccaggcacagaaagacaagcttctcatgttttcactcatttgtggaatgtaaacattcaagcaattgaaatcatggacattttatataccgttagatgtaaaagaagagaagacctgcttttggaaatggaaaagtaggttactttatacaaaatttccacagagaataactgtaaaagctagaaaagacaaaataaaatatctgtctaaatatgtcatcaacctatcaattcagtgaagatttttgggaccaaattctaaaaagcagagaagccaagagacagcctagaatgtaacacaacttttctcttgatacatttgccaattctgaaaagctgtagctggaagttgagaatatgagtatatctgtcagaaaattcataggggtcagggaggagggaggacgaaaattagatttagggctgtcaagaaggaggggttctggtaaacactccaggatttggttggagccagaagggctataaactatgaatgaggagaatcagaaatagaacatcctggcagggcacagtagcttatgcctgtaatcccagcactttgggaggaggaggtgagggggtcacttgagcgcaggagttggagtctagccttggcaacatggtgaaactccgtttctactaaaaacacaagaattagccacaaaaattagctgggtgtggtggtgtgtgcctgtagtcccagctacttgggaggctgaggcaggagaatcgtttgagcctgggaagcagaggttgcagtgagccaagatcgcaccgctacactccagcttgggagacagagcaagactctgtcccaaaaataaaagcagcctgcaattctgcaaagagactgaagccaggctttgaatgatcttagcccctgatcagattggtattacctgggagtgttagtgctcccagcctagatgcttgctagaaagaaaataaaatcgacatttagagactaaatgacttctataaatttttcatatagagctctacaattaatgaaaaaaaaccaaatatatttttaaaaatttgactagaaaaagtaagagaaaacaagcaatgcaaacagaccagaggatatctagctagtatagttatgagatacatatttgaaaatatctatgattagtatgctgaataaattaaaaggcaaggtggaaaacttgcacagggatctacaaattccaaaaggtaacaacatggaagtctagacctgaaaaattaataaccaaaattaagaactcagtagagaggttaaataacagacagcacaacagaagagataattagcaactgttagattggacagaagaaaatattgaagcaagggaagacaaacaaccagaaaataaaaaaaaaatacaaaatatatatggactatagtgaaaagttctaatatctagataataatacttggaatcccagaagaagagagagaacagaaataagcagtacatgaagaaataatcactctgaattttgacatactgacaaaagatatcaaaccacagttccaagaatgattaggcatcccatgcacaaacttcttctactattagtgcttggggatccacctgaggcctggtgtttcttgcactccttcttgtcaagctctgaactccttcctggtgagatgctaaaatcttgatttggcctctcagcttcttagccaccactttcactttcagcattcacaaatggctgcagggaatacatgtcccaaatatctgacccaccctgcttgaagaccctctgtttccacgtcttgacatcatctgttttcactgccttggaataggcttgcaagataaaatataagatggccagttaaatttaaacaatggataaccagcgaatacatttttagtgtaagtatatactatgtagtattggagatttatactaaaaagttattgtttatctgaaatttacatttaattgggtgtcttgtatttttatttgctaaatccagaaatctaccttagtccctcttctcggtcttcaaaggagtttagaaacatattgtccacatattttagctgttcttattgggaagctaaaacaacatagttggctattgctgggagagaaattcctgagttttaaaagataacttaattgaagtattacatgcataaagcaaagcacacaatcattgtatacagcctgatgctttttcaaaaaggtaacacacttacataacaacacccagatcaacagagaaatgattaccagcatcttagaagctctccttactcccctttcgagttaccgttattcccatccacaccaaaggtaactgttatcctgatttttaacagtatggattaattttgcttgttttcaaactttatagaaatgaaaccatatgctaagtgctcttttgcatctggtttctttgctcagcattatgtttatgagactcatccatagtattgtgtgaagttatagtttgtcaattttcatagtgatatagtatttaattgggtaagcattccacacttaattctctgattaaaggacatttggttaggtttcagttttttgtttgttacaagtagttctgccatgaccattcttatatatgccttcggtacatatacgtgtggattttggaggattatatttggggaataggtcacaagttgtgcatatgctcagttttactagatactaccaagtaattttttaaaaagtctgtatgagagttattgctctgtattcttggaagtccttggcatcatttgtgtcatcatgttacccattcttagtgtttgtctcaatggcagtgaaagtctgcctcgtgtctgtgatgggtcttgggcagcagagaggtggtgtaggctgttatcattgagaaggtactcttattaaccagctcccttcagtcctacatagactatcttgggttatcttactatatactcccacagtccacattttgtagtaatttcttgcataattggctgctttagccatgagtttattacctccatgaggatagagactaaaattgttttgtttttctgctatagtttaaatgtcccctccaacactcatgttgcaatttggttgccattgtaacagtgttgaaaatttgggcctttcagaggtgattgggccatgagggctccaccatcatgagtggattagtgctgttgtcatgggagtgggctagttgttgcaggagtgggttcctgataaaggaataaattcagtccccattttctctctgtctcatatattcacttggccttctgccttctgccttctgccacagaataacccttaccagatactagcaccatgctcttggacttcccagcctccagaactgtaagccaaataaactattgtgtttaaattatccagtcttttttttcctaacttttattttaggtttaggagtacatgtgcaggattgttatatagccaaattgcatgttgtgggggtttggtgtacagattatttagtcacccaggtgataagtatagtagctgagaggtactttttttgattctctctcttctcccagtctccatcctcaagtaggctctggtgtctgttgttgccctctttgcatccgtgtgttctcattgtttagctcccacttacaagtgagacataaaaaaaattaactagtgtttggtactctgtcatggcagcagaaaatagactaagaaatcacttaatagtttctggcataaatttggcactcaataaataactggtcaatgaataaatggatgagcttttgttgtgcctcccccccaaaaaaattttagaaatatatttactatttaaagagcttcccccttacgttgatgatatttaacatgacaaaggtgatgatactgacaaaaaccccatgtctaggtgacatcttatgatgtggttgtggggttagagtgtttaattggcattcttaaccatagaaatgtccacattcctttatatctttctattttttttgccccaacagcaaaacactaacaattagtatgagcgtcttccatatatgggtccactgtatgttactggagagaagcttttgaagggattcatggcaaccagttgaccaatcagcatatcttctccttggctctgtactcaggtctgtgctagagctgggtgacagagacagtttaataggtcttgatttctgccctcaatgagctttgactaattggaggcagtaaatttttatttaattaaaattaaaagggaggaaggttttcaaggcccaaagatagcatgagtttgtgcctgaaggcagtaggatgaaaggtgtgctctggtaccaataagcaggggtgtcaatagtactatctgggtggcaggatatgtggggatgattattaatctattctttctatatccccatagtttccaaactatttttacaattttaaagttgattgaaaaagaatcctaaatggttactgttgcagtatggaaggttttttttttttctttttggttggggtaagctataggcagaatggccacccaaccagttatttttctagtacaggagataggcaaaggccagtctgtggcatgtgcagtggcatagggaggagcagatagctgtataacatgcagagccactctgttatcgaatctcagcccaatctgggtctggaattttctctacatagactcttctcagtttgacactagggaaagttgtctttatttccctgttggtacttgagctatttccccaacattttcctgagtcataggccctatcatggccagaggattaagcttggaaagaaaacagatattctggttagatcttgagggctgtgggtgttctaaaaatgtattctcagctctcacctgttcttggcccctggcaagcaagaaaagcaacaagggtgatggccttcagctgtggcctcctgtggtgggtatgattgttgagtaagtccaaatggaaatgagacattggttcagcttcctagtctagactttctggcaacccagactcacttttcacagcaaaacaccagcagcaacaacgacaaatacaggcttcattttaggacagtctctgctgttagcatgttacatatattaacctgtttaactcacaacagctcttcaaggaagacattattattatcattttagtaatctcaggctcagagaggttcacacagctactaagtggcaggactggaattcaaaccccagaagtttggttcagagtctatgctcttaaccaccaggtaatcggccagactagacagagacacataggcatctggacaaactcattttacgggtaatttcaatctggtattgtgcaaatatatattcaacacagattgagaagagagattgagctctgtaataggagaaggtttaaacaaaaggatgtttcaccagcttgcaaaataaaattctacagttaactggatttactctacaggcatatttcgaagatactgtgagttcagttccagaccactgcaataaagcaaatattgcaataaaccaagtcaaacgaattttttgtcttctcggtgcatgtgaaagttatgttcacactatactacagtctattaagtgtgcaatagcattaaatttaagaaataatgaggatatcttaattaaaaatacaccataatgtgagccttcattgagttataatatttttgcggatgcagggtcttgtcttgatggtcactgattgatcagggtggtggctgccgaaggtggggtagttgtgacaattttctgaaataagacaacaatgacatttgctgcattgattgacacttcctttcacaaaagatttctctgtagcatgtgatgctgtttgataacattttacttacagtggaactgctttcaaaatttgagtcaatcctctcaaaccttgccgctgctttatcacaaagttcatgtaatattttaaatcctttgttgtcattcaataatgatcacagtatcttcacaggagtagattccatgtcaagaaaccactttctttgttcatccataagaagcagctccacatccattcaaattttgtcataagattgcagcaattcagtcccatcttctgactccacttgtatttctcttcctatgtccatcacatatacagttactttctccgctgaagtcttgaatccctcaaagtcatccatgagggttggaatcaacttcttccaaactcttgtttatgttgatattttgacattgtcctatgaatcatgaattttcttaatggtatctagaatggggcatcctttctagaaggttttcaattgatttagctcagacacatcagaggaatcactgtctatggtagctatagccttacaaaatgtttttcttatataataatgatgcttaaaaactgaaattatggccaggcttggtggctcacgcctgtaatcccagcactttgggaggccgaggtgggcagatcaggtcaggagattgagaccatcctggctaacatggtgaaaccccatctctactaaaagaacaaaaaattagctaggcatggtggcgggcgcctgtagtcccagctactcaggaggctgaggcaggagaatggcgtgagcccaggaggtggagcttgcagtgagccaagatcgcaccactgcactccagcctgggcaacagtgcgagtctctgtctcaagaaaaaaacaaaaacaaaaacaaacaaaaaaaaacaaaaaaacaaattacttcttgattcatggacttcataacagatgttgtcttagcaggcatgaaaacaagattaatcttgtacatctctatcagagctctttgctgaataggtgcattgtgaatgaacagtaatattttgaaagttatcctttgttctgagcagtaggcctcaaaagtgggtttaaaatattcagtaaaccatgctgtaaacacatgtgctgccatccaggctttgttgttccactttatagagcacaggcatagtagatttagcataattcttaaggaccctaggatttttggaattataaatgatgattgacttagacttaatgtcaatagctgcattagtccctaccacaagaatcagcctttctttgaaactttgaagccaggcattgatttctcctctctagctatcaatgtcccagatggcatcttcttccaatataaggctgtttcacctacattaaaaatctgttgcttagtgtattcacttttatcaattatcttagctacatcttctggatcacttgctgcagtttctgcatcagcccttgctgcttcaccttgcactttaggttttgaagatggcttctttctttaaacatcatgaaccaacctctgttagcttccaacttttcttcagcagcttcctcacatttctcagccttcatggaattgaagagagttagagctttgctctggaataggttttggcttaaggaaatcttgtggctggtttgatctattatctagaccactaattttttttttacaatatcagcaataaggcggttttgctttcttacacttttgtgttcactggagtagcacttttaatttcctacaagaacttttcatttgcaatcacaacttagctaactggaccaaaaggcatagcttggctttccacatgcctttctcattcagcttaattatttctagcttttatttaaaatgagagatttgtgactcttcacttcacttgaatgcctagagaccattgtagggttataaactggcctaatttcaatactgttgtgtctcaaggaataggaataccccaggagacacagacaggagaatggccaataggtggggcagtcagaacacacacaacacttactgattaagattggtgtgttatatgaatgcagttcatagtgcccccaaagcaattacagtcattgcttcaaaggtcactgatcatagatcaccatgacacatataataataatgaaaaagttgaaatattttgagaatttccaaaatgtgacaaaaaggcacaaagaacagatgctcctagaaaaatgacaccgacagacttgctagatgcagggtttctgcaaatctcaattgtaaagaaaaaaaaagcagtatctgtgacaaacactaaagctatttgcaatgacaggtatgtctataattagaagactgcttatgaacctacactgcgatcaaatagcatattttcacttctatctgctttccatttcttctgttacataagctcactcctccaaacaagctcggctgagtacatattcctcagtgtcactacacttctggtgatgttttcttatatctcatatttcacacacacacacacacacacacacacacagacacacacacacacacacacacagacacacacacacacacaaaccctgggaagctgcctagttacccaccccttagtcaagctctgccttggcctcaggctctctgaagaagggctcactgatgattgtggactatgcagggctgagagagtgaccggggcacactttaagtaggaaacaggaactttatttttgcaaagaaaatggaagataaacagaatgttctacgtgtggaaatgcctacattagctttgtgatctaccatccccaggatgtcaaaatgagggaatggaagaatgagaagcaaattgtttgatgctttgtcccatgtgtacttcagaggtcctcaggacccaaggcagcagcagctcccagagctgtggcagcagctggagccctgtgaaggctcacattcacagcagctggagctctggggtctgtggcagtgggacctgtggcacctgtagtgctcaggcagcagccaccacctcctgagctgcagcagcccccagagctggagccacggcagcccccagagctagagctgcagcaggaagagactgggcatagtgctgtgcactgggatggacagtttggggggcatttcagagtacacttggaagggcacttgcagggggctgacactgctgctggttctgctggcaggacatctgggcaggtgttcaatcaacctggaagagaataatgacatggtatggattagttaaatcaaggggcatgttttttacctgctctagaatgagtatgaagggcgatagtaaatgatatttagaaaacataaataagcatccagaggaaacatataaatctttcctctaattaaaagtacatagattttaaatgcagatgtagtaaacaacatcttattctcctttataataggacacaaggatttctcagtcttcatagtcctgcatgcagcattcaaaactctctgaagtgccaccatattattataaaaacaagcccctaaaatagatgaggttggcacacttgccttttggcccagggcagtttccagagtggcaaagtgccactgacatcttaagccacaaggcaatagtttcctctccctctgaattttattcctgttcagtatggcagaaatcaaatacataactctttttcctaagactctttacttcctccaatctctctgtccttctccaacccctctggtctcccaggttctcattcatcctggtcacacaaaagagcacagacatgtccctagggcgtcagagcagatgaggtgctggagctgggtatgtgtcttttatagacccaggcttggctccagtaagagcaggaagtggctcttgtccaaccaggcatgtgctcggtgatctgtgacattcccctctctccttgtccctgcaattcaaggaggccttgggagctcccaggacccctctctggggctagggtctagacacgctttatccagttgcaccctcttctaggctggagctctgaagggttaacttgggatgcacagggagccaatgtctggataaagatgctatttgttctttgggaaaactcaggtcaaagccatattttattttttatttttatttttcattgtggaaacattccgttctgatttcccccacgcttggggtttgtctttgaggtcctgctttaggtaccagccattcctaggctggttgttctggagttttgaattaggaagaaccctccccacccagccatccttcctgggacctgtccttcagggtggactctgggtctctgcttctccctcagctgtcctctgaggagcagctgtgctattctgatttattttacttgtgaggatagtgatgactgagctgatttagtcaaaacaattaactctttcttaatttggcaagaggaaggcaggctatagaggtcatgtctctgtaactatagtcaggaaacctggtgtcaattctagctgtaactcgtgacctttgaaatatcactcatgtttcctaggcatctgtgttctttttaaaatgatcaatgagtaccctaatactcattgatttgaacattaagaaatgaaaatatgtagcatgtgttttgtacgtagaagatgctcaataatgcatgctaaaacaaattgacagcatctaggccttatggggggttgaaagatggtcacttacggttgctacttttaaggagcttatccctaaactctaacaagtggcctgagaagggcttgccatcctggggagcttctaaatctggagtccagttatccctgggaatgaggaatgggagatgacattgactgagggattgagtacacttgacattgaaaaatcagggaagagttgggttagacagattttttcatttattgaaggcagtcattgtaccattcattgtttgaggagcagaataaagctgtgaactaaatggcagtggccactccctcactgaggttcccaaataaggagaaacatatgacctctaaaagtctcttttagaggtgctccattctctatttatttattacctattttcagacaaggtccctaccctccacaagctttcaggccaaatgtaaaatagatttaaaaaatgaacaaagtgtttggttaaatggacattcatttagcacaccagatgaggtctgtggacatcagtctggaatttgggatttggatgtgaatcagacacaacctctaaccttgagaagctcacagtccactagaatctctgaagcacttctttgcatgagaaaagcccatgaggtccaaagcaggtggctctgaatttcatctcctgaatcactactttgcaatgagatatgtgagatactttcattagtccaaatttttctttggtgttgtcagcctgagtttcctcattctctgtgaagagatgtttgtagcaaccatgatggagtgagaggcaggactgaagtgtatgggcatttacatgtggtgtgtgtgtgtgtgcatccatcatccatgcatgtacacacacacacacacacacacacacacacttatatacttaattggcggtgggtacaaaagcacaaaaaagccaattcccctggtttttggtggcaggggatagagaagcacttcattacactcaccggtgtccaagtatttagtgtgccttctcactgttccatgtactgaaatgcatatgaaacagcatactatttcacaaagttgtccctactccataagatttcttactagtattttaaaacattataagatatgtgtgtttatttctataattctgatcctatcagaatgtgagagctgctgagtaaagaaaccctgttttcatcctcttgggtccccgtaaagtggttgttcaaataaataaataattatgttagatggatgagtaaataatgatgaatgccagggtgatgatttcagaagtttatctccaagtccctttagactgggaatcaataacctccaaggtggtatctctaaatgtctccagaacctcttcattcatcagaaggtcttgctaggacctcaaatctacacccctcccaatatttgttctctttccaccatatgattatttctctggtcaagacatttgatatctggtcaagacatttggtataatctttgatctatcccttttccccatcacatatacacaaagggacatccagtcttgtagattcttttgaaaaaactctcttaaagttttctatcctctctttcctatttgtctcatctaagccccacctcacaaagcttggcaagaaagatgtgaccacctatttcatgagaagggactggcacgcagcgacccaggccttagagcctcagcccagtgaccaggttcttgggatctcaggctatctgaggcttatatttgggaaagggtgtggctcgttgaaggcccacaggtcttgggccccattgagaggctggagtgctcctacagctcttttggaaggagaatgtcaggaatggccctaagtgttccttggttgtgagagattttctcctgctctttccagagacaaggctcatttctgagcccagcctggggactcctcctatgaaaggtgtccctggttcttcttcttcctccttttggacacctctgcagcctgagctaattctgagactcatcctggtaagtgtgtctgtgcaaaaccaaaggacatctctggatttggcagttttgtggttttcagatgtttactctaagcattcttgtacatgtcttctaggagcagaattgctgaatcttggtgtatttagtagctaagaatttaaatttataatggagagctaatctgtttttcaaaatgattgaatttttatgcccaatatccttaaataaatttgaaacgatctactcctttatagttttgtactgttcgcctagaaaacaattttggccattgttttctatgtttcttaatagtactttagtttctcaactagttataagagaattcatactttttgtctcttcttgagcttattttactagattatactttttaatgtatgttttccattttgtctaagctttcaacgttggcagtgtatagttattgacagtctttcatttttatattttgttctctgctttattattgttatgaagatacataactttttaatttataatatttgatgataacttctctttttttaacctagattagtcttgccagggtgggttttctgggtatttgttgttgttgctgtttgtttgtttgcctattctggaattgggactcctctatttaaaaatatttctcatccttaaggatgagagttcttgccaagttttcctttcaactattttcagatcccagggtatggtggtcagggagctaccatggaggattaagtcccctcttgagtaaagccagggaaacatagagaaaccctgctcctgtgaagaactcaggaaaatggttgggaattaaattagtttgagtttcacatcctcatccttctttctccgaccccctagaaggtggtagactacaatctaaaaggtaggtaatattttttgccagggagggggaaggagaagtatcgaggtaaagtcctcacctgatgagctggtttcctgatgcttggactataaagtggggccttgacctcactgggggcttgacagagacactggagcctttccctcgtaattatttccagtcagaatctctaatactccccagcagaatatgaattcacaggcctaaatgataaaaacataaagtcacaagcatttaaaaagattccactaacatcagaggtattagaaataattcaccattgtttaaaatgaatacataagattctttgatgttctatgaagtaaattcttaattcatcagcactttttgcccctgaccaatacttttttaaaaaaagtattataaatatactgaatatgaaaagaagttgaatcaaaagacaagaaaaaagaaattgaatcaaaatacaaaactccttatgagatatccaaggaataataaatacaactaaatgtacagtaagggacacacaagttagaaaatataaaagaataacaacaacaaaaacccctaaaggataagacagaaggtaatgaatatagaagacagacaatggagatctaacttacatataatttgtatacctgaagaaggaaagaaagacaatgaattagaataaatacttcacattataattcagagacttttatctatgtatggagtaaaattctctttcttccactcaatgcaactataaaacctgggaagactgacaggaactagctagttgggagctagaaatagcagcagacagataggggaaggacatgagaattaaaaaagtagaactgaaaaggtgcatagcttcacttttcctcctttggtttctcctggcctgaacttaatgcaggtggaaacctggaaatgagagctgtgggggcacatacagagtttttgaagaagtcagctagttctggcttgaggagcaaaagggtaagcccatagaagatgtggaagtcccccatttcaatctccttgttctttcataccccatatctcaggcaactccatggtggatggcagtgacaacagctgataagggagctagcaggagtataaaatgtgagaagaggaactacttctccatttcatggagctgtaatcccaaaagggtggggccaacccctattgctttctttctctcactgtcttcccaattcttggtcctagacatgggcctagtcatataaatgtgtggagagaagggtaactagaggctcaatttctggcaagaagaccatgaaggtgagcctcgctgaacctgaaagtactgaggagattgcagagagagagacagaagctcaggaaagagaccccataaaattgtttatgaattccagagtttgctgtgaggacacacgtgcaaggctctgatcctcattagcagacaaaaaagtgataacttattaatagaggttctacttcccagatctcaggctgatgctggttggcactcactctggacagttatgaacagcactacaaaaacctcaaaaacttaattgataattggaatagttttacatggaaggttgcccattaaaatgaaaacatcaacattttccatcaaatttaaacaagatccagagtcttgtttagaatgttaaaaatatccagcatacaaacaattactttacaaaagaagaaccacgaaaatgtcactcgcataggaagaaacaataaacagaaaccaatgctcagataacacaaatattgaaattatctggcaaagactttaaagcagctattatatgaatgctcaaatgagcaattataaacactattgaaataatgttaaaataaaaagtctcagcaaagataataatataaagaagaaccaaatagaaatgttaacactaaaaaatgcaataattaaattttcaaaaagccactggataaatttaatagcagaaggagatgacaaagaaagagtcagtagacttgaaaatggatcaggagaaataatctaatctaaacaacagagagaaaaacaaacaagaaattagcagagcatcagggatctgtgagacaataacaaaatctatcatttatgtcattgaaatcccagaaagacagaagaatgagtgtagaactgaaaaaaatgtgtgaagaaataatagttgaaacttttcaagtttagtaaaagaaataaacatacagtttcaagaatcagagtgaacccaaaactcatgaaatcaccaagagtgatcccaagctaagctcaaaaaaccctgataacatcagctgaaaactaaagacacaggagtaatcttgaaaacagccagaaaaaatgatgcatcactaaaacaggagcaaagattcaaatcattgcagatttcttatcagaaatcacagaggccagaagaaagtagcttatcatttttaaagtactgaaggaaaacaacaaaaatgacaattgtcaaccagatatttacatgcagcaaataattttctgtctttcaacaatgaaggtgatatagagacattctcagatgggagaaaactaagggaatttagaacctgcccacctggacatccctagtacttccagctctctgcatgtatgggcaaagtggctccagaactcaagggcagcctagatactgatgaagagctgcaggtactggctgttgaaggtgagaaaacaacagaaggtgggggttggggtgggcagtgtgcacaagagcagtaaaaagggacaagagataatctaggtagtacatgcatgttgactgccaaaatttcccctgaagtatgctctttatattttaagaatcttaacagaggacttatattgctcatttccattcttcatttagactaactatgcatacacatcaaagttcatttgttcacaattagttttcactcatatacatttttgctttatttatggtaaaatttttcatattgtgtgccatctcattttatttcattgttttctgggtatacacatttatgttttcctcaattttaaatatttaaattattttttcactcagataacataatatatatttgcttttattttttctgaataaagatatacgcttttcttctcctttcaagtcttcaataaatctagaatttgcctgaagtatttggtgatgcctcccctcccttggtttcccatggtagagatagattgcattgttgccagtattcatgcccttatgcattgtgactttgcagttcccctcactgaggagcaaaatatatttcctaatcccttgacctcgagtttggccttctggctttctttggtcaatagaataacggagcagtgatggtatcccatgcccacaaggaaaacatgtccaagatagcctacaggacccaaaaggaggaatgaaagacccgtggagcagagctgaaccacccagctgagcccagcctaggtcacatttgacctccatcaccctgaagacctgcactctcacaagctaaataaataattgttctatgcattttgtttattacgttgtcgttgtgcactataattgaggccatagttaacagatatattcctgaactctaatcttagtctcatcaaccataaaaagctttgcagcgttctagagacttcccacttaggttttagcttattgtcctacatatccctgaacttgtcaaataccttaggggaaaactaggtgtgcacttgagggcccccatgtctctgctacaggctcagttgatttctttgtctcccagctatgttctttccatgcttaaaatctggattcttagtgttttacctgcccagaattgacaaatactctcaggattaaaagtggttgcagaagtcagctcctctccctggagtcttagctcctccagttcacactgctgcagcacttctctgctgccttccaaaacacaatttctggtttaatctgagttttatagttatgttagttaggagaactggtctctcaataactatttcatcttatctaatgaggaaagtttgcaagggaaggtatgttttgtaattagaaaatctaccaatataatcagtgcatttacagattaaagaaaaaacaaaaagatcatctcaatagatgtagaaaaaaatttaacaaactttaataccgttctcaatacagacctctgaaaacctgtaatcaaagagaatattcttattccactaaacagtaattagcaaaagtctgcagcatgtgttcagtcagccttcttgaactggaactcacaagtttaggttattttttctttttcttcattttgactgacactagaattttatgaaattttttgttatcaaaagacattttaaaatctattagagccaggcgtggtggtatgtgcctgtagtcccagctactcaggaggctgaggtgggaggattgcttgagaccaggagtttgagaccagcctaggtgacataacaatatctcttaaaaaagaaaatatatgagaataatcgtgcttcttctccttgcttgagctacagataagcactttaaaaaaaaacataaaactgctttcattatattgccattacatttttaaagtcagatggaccttagacagagaaactgatgctcacagaggtgaaatgactgatcccaagtcacaaatgaaaatgcaggcaaagccagagctagaggacttttttttaaattcccagtctgctgttggaccctaaacactttgagccttgcacaaaagcttgcactgtctccttgctactgatagaaggaagtcaattaaataaaaaattttctcctaattttcaacttcatctgctgactacaacttggcttttaaatatagtcttcctccttccatttttcagcaatgcaaaccctcaactggagtcatatagatctacttactctgcatttactgactttagttgcacttttaaagtgtggaatcatgcacgcatccctgcttgaaacatgcttctctattttctccatctaccccagcagctctctgtggactgataaactcttgtctgtcagctccaaacctacccttctgggctctacttcgtgatgctggcctgggctttgcaaccgtggttctacttcgcgggcagtcctctattaggttttgtcactagggggcgcaagagacgcagaagtcaggagagaaagaaaggcctgtaagtgtcaccctatagattttttttttttttttttttaatctggcagcagcagttggttcctgttcccagttttctccacacttccagaactatcctcttctcctttcctcagaagcaccggccccactagccagtgtcccacctcagaagcttgggttctcgctctgcaggtctctcctctaaattcctaggtttcaagaagtccatctcctttcccttgttccctatccttagtgtggcaatagctgttccgcgtgatgctagaattctccatatttgccttttcaatcctctaacacctgtttaatccaatgcttattgtttctgtcaaaataaggagtgtttctgttttcctgaatggacacagactgatacaaatctctaataggttaacatggaggaactgatggacaaaaagaatatcctgaaataataatgtacttatttcattttgcgaacttgtaacaattttactggcagaaaaatgtgacttataaagtgaaaataggtctatatagttcaaaagcaattgtacctgacgttttaagaaatcgtagatatttatactatttcttgctagcagaaagtcattgaaatgtcaaatgtttaagtaaaatgtaagagtaaaacatagtttcttaaaattgggaagactttgtgaagggaaagagtgtaagtatccagttcttacagaagaactttgatagacagggagaacaccgacattcaatgaatgcaataggatcccttattttgaaaaaacatttaaaaaaagaatcctctttaaaaagttacagttaatatatgtttttgaaaagagaaagagagtgagaagctggatcacagactgaattaggaagaaaggaaacttatttatttatttccaagaaggaacaggaccatagagtcttgagaaaccagattcttgtctcaagggtcaggaatcctatgccgctttatggagtcccagcctaggaaataatatactttgatgagatttcgttctctagcttcagaagagtaactcagtatctccctgggaaggatggattgaagagacagggagggaaatgtcaggaattaccctgcagatgccccagtatgggaggaaccacttcctgctccacccagaaccatggctcactaaggcccagtcaggcgagtgcctgcctataaaatgtgtgtcaggaccccgcttctcatctgccctgacaccctggggactgcctgctccacacctgggtctgaccagggtgagtggatcttttggaacctagacagagcacaactgaaagggtaagtagctgttgaaaatcacagggggaaaggaaagacaggaaaaaagagggtaataggaggagagatgttggcctaggaagatccagcctgggaattaagagtccctgggaattagagggattagccaatccaaattcttgccaatatctggcttctggcaactgagtcagctggctggggagggattattccacgctattcacatctcatagatccatttctagatgcttagagaagatggcagaggcacacagagaaaatggcaatacccaatattaccatgaaatgccaactggtatcctttcctctacctcagatataattccctccctccttcccttccccaatctcttcctccctcccttcttggctacctttcttttctcctttatttattcattcatatattattcctatatcaccagctatttattgagctcctactaattacctggtgttattctagacattggaatatagaagtatgcaaaagaggggaggataatccctgctcttgtggtgcttccatttcagggggaaatctacatttattggacatcatctatgtgacaagaactgtgccatatcttagagacagagaaatgaacaagatggaggctttggcttgactgtgtgtgtgtgggggagggtggggggttatgatttgttcaatatgtcagcagccccagggtagattccaaaggaggaaacaatgatctaagatttaacaagtctataaaacacctctattggcttttaggttgactgaactcccacaaagatgtcctgccagcaaacccagcagctgtgccagcctcctcttaaagggcccactaccaagtgccccccaaaatgtccccctaagagccctcctaaggtgccctgttcaagtctcttcctgctgtgggcctagctctgggactgctgtgggcctagctttggggctgctgtggcttcagctgatgttggcatcagagctccagctattgctttggggctgctgctaccaggactttgagcatcacctgagtaaccgaaacaccaacaacctgcaccagtctcatgcatctcgttcatcagtgcctttcataccttcaagagctcttgcctcagagcattgctatgcctgaggtgtgtctcagaagcagccattggcacagtggcttggggctgggctcaaaaatttgctctcttgaagtttggatgtgattgctctgaacaagctgctttgccacaataaatattttcaagtttccttgcttctatttttaaatattttatgtttccatctacttaccaattcccatttcttcttcctgaatacactgctaaggttcctaactttggatgaatagaagaaaaatcaaccctccaacataaattaacttttaaaaatacataaatgctttgttttaataaataaaataagatgaaataaataacctaaaatatgaacacactgttgaaataaataaattaaggatataatggtgtatcggggaaaatattactataatatgttcaaaatattcctttaaataattgtcttttaggtgactatgaaagaaaatgtccttgcatataaaagacattgtttcctaaatgctcttacgataaaatatgagataaatgtataattttgtgctcagtctctgtggcggagctagctgttacataaaagaggatttctgcagaggaatgccatggtttccctgagtccaaatgaaggaagcatattatcccctgctctgattctttgttccttctcatgcacaggtaaagctaattgaattaagccctcttgacaaccacacatcaaaatagaagcccatttccaaatgtgcagtgagccggagaggatgcctatgtggttcttccttgtccttttcactcttacagcctcggggtggggatgtctcaaagacatccagcttacagtttctccagcctacagacccttctgattgatgtggtggagagctattaagcaatcttagtactcacctctgttggacctccagaatagtcagttaggaaaggccttgagaaataaggttaggtctcaatgggaattcctagcaacatttgaaaacctgcagtgggatagttccacccacctgaatgcctatacagatgttcctcaacttatgatgggtttatgtccagataaacctatggcgagttgaaaatatcctaagccaaaaacacacttaatataactaacctaccaaacatcatagcttagcctagccttccttaaacaggcttagaacacttacattagccaatagttgagcaagatcatctggcaacagcgtacaccatagagtattgactgtttactcttgcaaccccatagttgactgggagctgcagcagcatgccaggcatcaacacagactttcatttataggatgtattgctagctttggaaaatatcaaaattcaaaatcccaagtataatttctaccgaaataataaagttgaaaaatcctaagttgaacttacgatggtaagttgagaactatttataattagtaattatatattttcttttatttgtcaagcttctgtctctacattgaaacacagtcacagtggggagagattatatttccttcacgtcatgttgtatctccagagttgaccacatagtcaacaatacttgctgagtgtatgtgagagtgaattaatgaactctgatttttgagcttactaatggaggacagtccaggaaatcctcaaattgttttctctttagagatgttctgtttttttttttaattcacctgatcatatccttctctcatttactcttgtaagacctgcttaatgattacctaatttgctcagccagaatctttgaaaaatagttccttgctctcggaaatcccaaggcatagatatgcagtgattacaattataatatttaattaatgtgacctattcatctaacactgaaattcttctaattccagtgattaagaagatagaaatactggatataaatggacataggcagtgagggtgttggtgtgtgtgtgtagtgatcatatgtaattaacatagttttatcccatgatagtctataaatagtgctctctgggtcatgaaaaatgatgggttctgtcttggttttgattgagaagtaagtgcatagatattgcataaaaccaggaggactggagagagggagcacagcattcagctggggaggcccttggtctttgcacttcgcactttggttccacagaggtatagtcagtacagcacaaacaaggctgctgacactgcacagtagctggagctgcttcccatgcaggggtcagtcacacaggaagaactggaggtgaacatgggctgtgcactggagtggcactgcggagggcccttcaaaggcattggcattgctggcggtgttttgtcaaggtatctgagtttgaaagtgaattgaataataagtcagataaattagagccaggacaggaataattttgcccttttaaacctattcacggtgtgctggcagacagtttataaaatacattagtatctaattagtacctgtaaagaaacatattaccccaagttaaaagtgttagaagtgacattcctgaaaacagaactaatgctaaatcaatgtcaatttcggtctctcatcatttcatttcatatctacagacccaattcctacctactgtatttcatgagctttaagagggtatcagttgtaaggggcacccttatttcatgcatcataaggaaagagaaaaatgttgcaaattcaactattacatgccaccaatcatatgctatatgctgatttaagggctgttaacaaatgtaagaagagtgtatcatggaattgatgaattaagataagtataaaacccatcttctttaggtcatataaatatgtatgtagttactagatgggccattcttgctttgcccagaacacccctctgctgtcctgctccctatagcagggacctcttctcctctcgtattccatactcctggtgttgctctttagactcccacatggttctgtcgagagccagttcaatggcccccagtggtaaactcactctggcaaccagctaaggaaaatggcaggtcccagatgaggcaaaacagatgcaggacagtgttaggaaatctcttaaaagttatgctaatatcaagacctgaaatgagtcccagttctggcaggaccacgacacatgaattctccaacagttctctgcctggagttcatggccctctaatgtctatcaccaaatgtgacttcagcaaagagccattctggacctgggttctcaagccccactttcctgtgaaatcatctcttgttaaaaattaggggataaaattgtccagaacttaaaattaagccaaaaagtaatttcggatcagtcttttaaattttcacttcttcctagtaactaacaaccttgcctaagatttataagactctagatttttttaaaaataattggtgggatgattttgcttacaatatgtggtgttgattaaggcccagactctgtaaagctagattgaacttacagaagatttataacctcatggtttcattgccttttaaaactgtaaccagtatgtatctaaatttgcaatcttgttttagaattttttcctctgactgtatataatttgttgtctccaattctttgaaccagcattaccatcatgctggttcccttattaacaagtgaaacaaatctttgatatatgtctgctatatattaacatatataaatatacttttaactttttggaagttatagttaaataaacccttatctctacacttactcttttgggagtgaaaacaggcccaaaccagacagtgccagacagtatcaacaagaagatcaaaaggactacaaagatatagtaaagggaaaatttggactagtgaatctattaaataaggtgagatacatcaagatacatggtaaggctttttcttgtactgtggctaaaataaatttccagcatttcatggggaataattttctggaatatatgcagtttaagctcccagggagacaaatcaaggagctacatggagagaccagcctgcaggatactgactttccagatgaggtgaacttcagatgaaatgtctgaaatcacccccaggccattcttcttatgacacctatgtgctccttcatgaggtcttgcaatcatgcattgatcctgccaacattcgtgtggcaatggtttggctggtccctgagggaacatgggcaacttgacacagggtctcctggctcagagggatcacatatgatggtgtgaggactgtggagacagaagcaagaatacttgcaggcaggtgtttcttcactgacttgtgaaccaattctcaacattttctgagttataaagggacaaaggggacatgttaaagagctgcttatctcccagttctggtttcccaggggatcagatcccattagctcttccattgcttattcaaccactcaatacagatgttcatgtatctgcatgttcatttcacctgcacttttatatgaatacagcatacacacatacagtgcacacatgcacacacgcacacacaggcttgcctcccctacttcctcacttacaacattgttacaaatatctttgtcaaagagtatgaggaagctgagggtgatatcaccatgaagacagtggaatgaactaacatcttttaatcacattgggaaatagtgactcaggaggttcagtccccaaacgtcatcttctttggtacccatgtttgtctgcagtcatcttcaaaagggccaaaattctacagtccttgaggtcatgggctacttattattcacctctatatccgtatgtttggacatacatgatccaagaatgttgtaggctttcaaagaatgccttttgaattcactgccctggtcacactgttgacttactttatccttcaggtaaaagctccctgagagcaggaatcagatctgataataggattggataactaggagaatagaatccctcagttagaagctgacaatgggaaactatactttctccgcatcctcccctcccccataagtaggcattaggcaatgtgaaggcgcggtctgtttctgttttaatcagaggtgtgaatatttttttcaattctaattttaacatctttattgagacgtaattcacatattgtatagttcacttgtttaaagtgtaaattcaatggttttcagtatattcacagagttggacaatcaccaccacaattttagaacattgtcattactccacaaagaaaacctgtattcattggcagtaacttcccaatttctcccagcccgctaaagcacctggaagccactgatatttctcagaggacaggcataaacataaaaggagatacagggaacagaatctcgtccaggctcccattcctcggatgtcctgagtcagctcttcaggggtccagcctgggagaggctgtaactggctaaagcctcatcccctttcatttccagagatttgcctactctacacatttcatataaataacatcatacaatatgcagtcttttatgactggcttctttcacttagtgtaatgttttcaaggttcacactcaatgtatctgtttaaactaaatgaataaatgactgggtaactctgtctagtgcaaccctgaatcagaactctgaataactagacccctggctgaccctctacttcctggtaggaaaggagttccctctgcataggagccccaagaaatgatgtgtacttcccaagagaggtttcaaataatctcagtgtctgattgaattaaaccctctgagggtaaggactctatacaggcaattaatgacacataagacctgggcaagtacccaacacatggcattagttttctttgaaacacatatttattaagggtctatcaggcatatagtgttgtaccaagttttttcttacttcttatttaatattcaaaacagctcagtgagataggtatatctggtttataatggccattacatatgagaactgatactcatagtgagtatcataatgacactctagcaattgttgataattgttctagctacttctataggttaccaagttatcatatgcaagtttcctgattccggcaatggattcaatacaattgcttcgactaaaggaaacgtttagattttagagggaattgcttattctcaatcattctccttgctctaggagacagaatcaactcagatttaattcagtgaaagcttgtcatgatgagtctgaggaaaagcagaaactcagaggccgagaggaaggactgtgagcctagtcaagggagggatgcctagaaagagccaaggctgtagaagccccctgggatggctggatgcacagcaggacatggaagacaaactgctcaaggtgcagggagtcataatggaacatttccacaaggtcagggaatgctgtggctcagagctgatgtaacctcagaggacaggaataaaaaagatgcaaggaacagaaccatgtccaggcatgggtgccttgggttccctaagttaactctttagggctcccacctgctggaggctctgactggctaaagcctctctagaccacagccccagagaggagtcctagaagctcccgaggcctctttgggtgcagggactaggagacaggagaatgtcaggaatgacccagcacgtgcctggttgtgcaagagccacctcctgctcttcccagagccaagtctgagtcctataaaagacacatccagcttcagcacctcatctgctctgactccccagggacgtgtctgtgcttttgcatgtgaccagggtgagtggcaacctgggataccagaagggtattagcaaggtagagggatggggaggatggaggtaggctggagaaagatagttgtgcgcttgtgttctcccatactgagcaggaataggactcagtttgcctcaaatctctagaagctctgggacttgctggagctcacgtagaagggaatagctaactgtgcccatctttcccaactctgtcttcaatgacttcatgttggccatcttgggcagatttgcaccatggaaattgtcaaatgcttcaggccaggcccttttacctggagttttcatggctaaacattttccagaggatccctggtgtgtctacagcacccatctgggcgctggggcttgtattaagagaacaggtacttcatggagctgtgaatactctattcaggcttgtgaagatagagcaatcccagcttccctctgaaaggaagaatatgaagctcattctgttgattttttaatctatgtacttttatctggaagaaagattcaagttgtttctttcaggttactgatgtgactgtattacctaaatatcattcttcttctacacatgcattgattttagaggaggcataattatgacctttggtttgaaatatttaaagagtttcattattatcttttaggttgactaaactcctgccaggatgtcttgccagcaaaaccagcagcagtgccagccccctcccaaatgtcctcccaagtgtaccccaaaatgtccacctaagtgtccccccaaatgcccaccacagtgcccagctccatgttcccctgcagtctcttcctgctgtggtcccagctctgggagctgctgtggtcccagctctgggggctgctgcagctctgggggtggtggctgctgcctgagccaccacaggccccgtctcttccaccggcgccggcaccagagccccgattgctgtgagagtgaaccttctggggcctctggctgctgccacagctctgggggctgctgctgacctgggctgcagaagagctctggtactgaatggtcaaaaacctgctacagcctgatgcttaactatttccccttcctttcattccactcatgggtggacagggaccacaaagactcatggggcttccccagaactttgtgcttgatggagcaccccagatggaagccttctttttctcctttacctcatattgtaataaagctctgatttctgactctttaaatgtcttggtcatactcttctcttctgagatttctaatgtcttctaacggtcagggccccagagaaattctcttcatgaggcaaggacaggacatgagcaagtgatacatgaaaggctgctccgaggaactgattaccccaactgcagggtagatggagctccaagatgatcacctctggcaacggcagctttgactttgtccccactaagccagacatatgttctaattttctgtgtattccagacattgggaaggttgggaagctctgtagacttgttcttctctagggagaagaacacatctctatgaagcaaaacttccctgctgttcgaatcaatagttgaataaaatgcttgaaacgaatgttgagacccctcctcctgcaaagtacagcccatggtcagtgaactcccttcccaggagggtgagtctggttaagattcacttcttgacttgctctctcagacacctggcgtctcttcctctcagtgtgaagggaaaagggacacagcagggggaaataaggactagtgcttcttaggttcaggctgacaggtgtctacatgaagatgatggattcagtgcagagagattctgtcagaggtggagtctcttattaagatgttcatctgcctcctcatccttactgctgctaagacaaacacccagctgtttaaccagtctgagattctgtactctccgcattttaaatcacccactgcactgagtcagtttatttgacttgatgctcttcattattttttccagtctcattattaactgaattttcaagtccctgaccagtagtaattttgagcttctaaaaatatgtacattggccatttctacaaaatttgtaatatgattttaaattttcttttcaattttcaagagctcttgatatatcatggatattaaccttgatctgtgtttattaaaatatttaatgcatcagatttaattgaatccatttataatagcttttgctatggaaagatttttagtttttatatactcaaatatgactttcttcgcttttatagcttcagggtttcctgagttggttaagaagttttcccttgtccttagtgtttacatgtgagcagcaaaacaaatgaaaaaaccaaacagtacaaaatggagtgccaagcatgggacctaaggttgcccggggcagttgaaggctggcctacagagaggtggacacccaagtgtgctttcagggacctctgccttaagtaagagcaacccaccggccattcccttccccagtgggcctgctatctgggcctccatgtgctcctttcatagtgagcaacttcctttctctatctaaccctccatacacagaataatttcccatctaactttttttgttttaaattatgctttaagttctgggatacatgtgcagaacgtgcaggtttgttacataggtatacacgtgccatggtggtttgctgcacccatcaacctgtcaactacattaggtatctctgctaatgctatccctcccctagccccctacccactgacaggccctggtgtgtgatgttcccctccatgtgtccatgtgttctcatttttcaactcacacttatgattgtgaacatgcagtgtttggttttctgttcctgtgttagtttgctgagaataatggtttccagattcatccatgtccccccaaaggacatgaactcatccttttttatggctgcatagtattccatggtgcatatgtgccatattttctttatccattctaacatttgtttttagctgcatcttactttgtgtttggcatgtgtgcaggtgtgttagaaaattatgttcggatgctatcagaggaactcaaaattacagcaatttaaaaaggaaagcagactatttccactcacatatgatgaagtcagaggtcagtggtccatggctggtacggtggttccctggagtcttcaaagatggatacccctatgtcttgtcaattcattgttagcagttgtttcctgggaggtagttggtgatctcgaggtgcctgatagagttctgatctgcaaggctgtgcttcaggtaggaagaaggagaaagggtgggtaaaaggccctgaccccagtaaagcctcttacctgagctttcctaaagtcccaacaatttcctgaatctcactggctgcttgtacatacaagggggatggagaagtgtaaattttgatatctgaacatgatttggttctggtcaaaatttaaagatataagttaagaatgaagggggcatgtatgttgggcactatccaattaagtaattttctatacagtttgacctgctgagtaaagacagctggattgctggttatctcgaaatagtgacacagactctctgagtgcacttcaattacctcttaacacaaacattcaggaacatcctgcccacagttccacctccatgggctctgctgtatgcactgaggcaagcctgcatggaaggttgattaggcaggggaattccctggtgaggctgaggtctggagtgctgtggggagctccctgcagacaggcacaagacctggcttatggatgcctggggtaggctaagagttacttctgcctgtctccccatctctaatccatccatcacccagctgtgggccaagaaccaggggtctggatcatctctcaagggcaggaagagggtgagactctgagaagtgtgcaagaagaaaacatatttggtgttatggcttcatctctttcaaaggtatctagagttggagggtgacagatgattaactctgagttgggttatctgaaatatgacccaagtgaggatagtcaacagtaaccagaacatattatgaaaaggaaaatgtagatgtattgtcacctgggccagaatccccacagagcactttcacctccacatcgagtgaaaattctacctggtcactctcttgtgtccccaaagggtcatcccaggaagagggaagagtagaaaaggagttttgggccaggatggattcttgagtgtgtggttatctcaactcggaccctctgagatttcatagcagtgcccgagagctgcggcgctgctctctcacagactccccaggctctgtcgctgctgctgcagcagctctgcagttaaagtcagctggctctgtggtgcccatgctaactccaggagcagctgctcccagagtaggaagaacagtatctccagtgctaagaaaaacttgagactgagggatgagcatattgccaggctcttgggaggaagcctgctgctggctcagttttcaggatatctcaacatgagttaagctgagagtgaattcagcagtagaccacatgtgtaaacctagaataaggatacctttgctttttctaaacaattatccctctgcttctaattaattggcaaagccattaatatttagaaagacattccccgtgttaccatttcatggttgctctttggtcttgctaggtcagatttcaatcctagtcaacccccatgctggttgcattgctgcagctgcacacctaattcagaactctgtacagtaattgtagaattaggtaattctaaacttttgtgcttgttataagatacgtactcttataagtgttttatgtgtaactcaaccaaaggatcaattaattcacacaatgttgctattaggtaattacagttattttccacacttcatagatgagaaaacagaggtacagacaactttgagaacatttctagggttctaaggcaagtacctggtactcagaatataactctaggtgatatagctacttagtctgtgatctgaaccagttctctggagttaaactggaaaggcctgcattatttaccatgtgtgaaattgaaacagcttatggtaagatcttctcaacaagctagacttaaagcagctatcccctaattttcctgcctggtatactaatgtttctgggctagttcccatactgcacaaaagaaatctcgatttctcatacctttctcttcacccatgtccctctgtcctttctgaagaatatagtcacagtgggcagagattatatttcttttatatcatgttgtactccagagtttgctacatagtcaacaatacatgctgagtgtgtgtgagagtgatttttgaactctgaatattgaacttactaatggaagacagtcccaaaaaatcctcagtttttttttctctttagtgatgttctgttcttttaattcacctgatcatatccttctctcatttactctcataaggctgtctaatgtttacctaatttgctcagtactgagtctttggaaatagttccttgctccagggaatcccaaggcatggatagacagtgattgcaattataatatttgattaatgtaacctattcatataacactaaaatttttctaattctagtgattaaaatgatataaatactggatacaaatgggcataggcagtgtgggcactggtgtatgtgtgtgaagggatcatatgtaattaacatagttttatcccgtgataacctataaatagtgctgtctgggtcatgaaaaactataggttctgtctttgttttgattgggaagtaagtgcacagatattgcataaaagagaggttacatggacaatgagtttgtcaggaacttggtatgagagagagatttagaaagcatagttataaataatctggaaaattcatcccaccaaacaaaataattggctatctggaccaaacagttggtctgacattgtgtgtgtgtgtgtgtgtgtgtgtgtgtgtgtgtgtgtatggtactgtatctaagctgtgtgtaaatttgttctcagaaacctgctgaccttatactaaagttctcaaaatcttttttggttaaattttctgaactttattcccagctgtgtgaagttgggctatttgtttagtcctaggagtctttgttttctcattagtatagtggggatattaatactacctacatcacagaattggcatgaggattaaatgagataatgtatataaaacaattaaataggacctagaacaaaataggtggtcaataagcatcagttattatattacattttgttatttttatcatttgtacagatgtgtgtgtatatatgtatatatacatatggaggcagttgacccaaaagtacagttccactcaatgtatacctcaggggaagacatggaggtaaggagaactgttttagttagagatttccagagaaatagaagagatggagggataagtttatattaggagattggctaatgtgatgactgtgggggctggcaagtctgaaatcttgccagaccccacaatcatcgcatgataattgtgatgattatgcaggccagcaggctggaaattcaggtaacagttgatgttgcagccttgagtctaaattctgcaaggcagtagtctggaaacaggcagagtttctatatggcagtgttgatgataatttcttcttctttggaaacctcagtctctgctattaaaggcttcagctgataggatgaggctcacgttaggaaagataatcaacctagtcagtctactgattacatgcatacaaagcaacatctggactggtgtttgatcaacaactggatatcataggatagcctaggcaaaattaaccatcacagagactgagaggatacatggaggtcattagagatatgatccaacagacagaagaggtcttctgttgacagaagagggtcagcagtgaccaggacacactaagaacatgccatgatggttttattttcacttaggataaaggcaaatttctggacagacctttggagaatattgggaaaacagaaccttctacctggtaaccccatgagtctcaacaaggctgtgatgttaggaggactggagggagggagtgcagcatgtggctggggaggcccttggcctttgcactttggttccacagaggtgtagtcagtacagcacagacaaggctgctgaccactgcacggtagctggaactctgggagctgatgaagctgtagctgcttcccatgcggggtcagtcacacaagaagaactggaggtgaacatgggctgtgcactggagtggcactgtgaagggctctttaaaggcattggcattactggtggtgttttggcaaggtatctgagtttgaaaatgaatcgagcaataagtcagataaattagagccaatatgggcataattttgcccttttaaacctattcatggtgtgctggcagacagtttataaaatacattagtatctaatagtacctatgaagaaccatataaccccaagttaaaagtgttagaagtgacatttctgaaaacagaactaatgctaaatcaatgtcaatttctgtctctcatcatttcatttcatatctacagacccatttactacctactatatttcatgagcgtaaagaggctatcagttgtaaggggcacccttatttcatgcaccacaaggaaataaaaattttgcaaattcaactattacatgccaccattcatatggtatacactgatttaagggctgttaaaaaatgtaagaagagtgtatcatggaattgatgaattaagtataaaatccatcctcttcaggtcatataaacatgtatgtacaaactagacaggccaattcttgctttgcccaggacacccctctgctgtgctcctccctatcactgggccgtcttctcctttcatattccatactcccggtgttgctcttaagactcccatatggttctgctgagagccagtttgatggctccccctggcaaactcaccctggtaaccaggcaaggaaaatggcatgtcccagatgaggcaaaacagatgcggggcagtgttgggacatctcttataagctatgctaataccaagatctgaagtgagtcccagctctagcaggaccacgacacgtgaattctccagcagctctctgcctggaattcatgcccctctgatgtccatcagccaatatgacttcagcaagaacccattctggacctgggttttgaagccccagtttctgagaaaccatctcttgttaggaaattgggggttaaacttatccaaaacttaaaattaagcaaaaaagtgatttctgattagtcttttaaatttttacttcttcctagtaactaacaaccttgcctaaggtgtatatgactctctaggtttttaaaaaaaatggtggcatgattttacttaatgtatttggtattgatcaaggcccagacactgtaaagctagatttaaattatagaagatttgtaagttgaaaattattttgtgtgctctagaaaatttaacctaatggtttcattgcctttgaaaactttaaccagttttgtatctaaatttgcaatcttgttccagaatttttttggtctctcctattctttgaaccagcattaccatcatgctgattctcttattaacaagtgaaacaaatctttataatatgcctgctatatatttatatgagtcatgcttttaactttttggaaattacaattcaataaacccttatctccacacataccctttcaggagtggaaactgggccaaaatcagacagtgccagacagtgttgacaagaagatgaaaaggactacaaagatatagtaaacggaaaatttggattagtgaatctactaaataagatgagatacatcaagggacatggtaaggctttttcttgtactgtggctaaaataaagttccagcatttggtgggggataattttctggaatatacggagtttaagttcccagggagacaattcaaggagctacttggaaatatcagctttcaggagactgactttccagatgaggtgaacttcagatgaaatgtctggaatcaatcccaggccattcttttcatgtcacctgtgtacttgttcatgtggtcctgcaatcatgcattgattctgccaacactcatgagacaattaagtgtttggctggtccctgagggaacatgcacaatgtgacatggggtcttctggctcagagggatcacctatgatgatgtgagggctgtggagacagaagcaagaatacttgcaggcaggtgtttcttcactgacttgtgaactaattatcaacattttctgagatataaagggacaaaggggacatgttaaacagctgcttatctcccagttctggtttcccaggggatcgggtcccattaattcttccatcgcttattcaaccactcaatacagacgctcatgtatgtgcatgttcattttacctgaatttttgtataaatacaacatacacacatacagagcacacacccacatacacacacacacagacacagacttgcctcccctacttcctcacttaccacattgttacaaatatctttgtcaaagagtatgaggaagctgagggtgatatcaccatgaagacagtggaatgaactaacatgttctaatcacactgggaaatagtgactcaggaggttcaggccccaaacgtcatcttctttggacctatgtttgtctgcagtcatcttcaaaaaggctacaaaaattctacagtccttgaggtcatgggctacttattattcacctctatatccctatatttggacatacatgattcaagaacgttgtaggctttcaaagaatgccttttgaattcactgctctgaccacactgttgacttactttatccttcaggtaaaagcttcctgagagcaggaatcagatctgataataggattgcataactaggagaacagaatccctcagttagaagctgacaatgggaaactatgctttctccgcatcctcccctcccccactaagtaggcattaggcaatgtgaaggcacagtctgtttctgttttaatcagaggtgtgaatatctatttttttcaattctaatttttaacacctttattgagatgtaattaacatatttgtagttcatttgtttaaagtgtaaattcaatggttttcagtatattcacagagttggacaatcaccaccataattttagaacattttcattacttcacaaagaaaacctgtatccattggcagtaacttctcaatatctcccagcccgctaaagcacctggaagccactgatatttctcagaggacaggcataaacataaaaggagatacagggaacagaatctcatccaggctcttgttcctcggatgccctgagtcagctcttcaggggtccagcctgggagaggctgtaactggctaaagcctcatcccctttctatttccagagatttgcctactctacacatttcatataaataacatcatacaatatgcagtcttttgtgactggcttctttcacgtagtgtaatgttttcaaggttcacactcaatgtatctgtttaaactaaatgaataaatgactgggtaactctgtctagtgcaaccctgaatcagaactctgaataactagattcctggctgaccctctacttcctggtaggaaaggagttccctctgcataggagccccaagaaatgatgtctacttcccaagacaggtttcaaataatctaagtgtctggtggagttaagctctctgagggtaagggctctatatgggcaattaatgacacataagaccggggcaagtatccaatacatggcattagtttttctattaaacatatatttattaagggtctatcaggcacaaaatgtcatacttagctctttcttgcttctcactttatattacaaacagctcagtgagataggtatatctcactgataggtttataatgggcattatatgtgagaactgatactcacagtgagtatcatagtaatactctagcaattattgataattgttacagcaactttcagagattacccagttatcatatgcaagttttctgattccagtagcacattcaatacaagtcctctgactgaaggaaatgtttagattttagagggaattgtttattctcaatcattctccttgctttaggtgacagaatcaactcagatttaatccaccgaatctgcttgccatggtgagtcggaggaaaagcagaaacacagaggccaggaggaagggctgagagcctaggcaagggagggatgcctagaaaaagccaaggctgtagaagccctctgggatggctggatccacagcaggacatggaagagaaactgctcagggtggagggagtcataatggaacatttccacaaggtcagggaaagctgtggctcagaactgatgtttcctcagaggacatgcattaaaaaaatgcagggaacagaatcttgtccaggtgtgggtcccttgggtaccctaagttaactctttagggttcccacctggtggaggctctgactggctacagcctctctagactgcagccccagagaggagtcctggaagctcctgaggcctctttggattgcagggactaagaggcaggagaatgtcaggaatgacccagcgtgtgcctggttgtgcaagagccacctcctgctctttccagagccaagcctgggccctataaaagacacatccagcttcagcatctcatctgctctgactccccagggacgtgtctgtgctcctgcgtgtgaccagggtgagtggcaacctgggataccagaggggtatgagcaaggcagagggatggggaggatggaggtaggctggagaaagagttgtgtgcttgtgttctgccatactgagcaggaatgggactcagcctgcctcgaatctgttgaggctctgaggcctaccggagctcatataggtggggaaagctaactgtgcacatcttttccaattctgtgttcagtgacttcatgttggtaacttcaaaactgctgtgttgggcatatttacaccatggaaactggcaaatacttcaagccaggctcttttatctggaggtttcattgcaaaatattttccagaggaccccttggtatgtcctgcaacacccagcttgtccttagggcttgtattaaaggaataggtacttcagggagctgtgaatactctattcgggcttgtgaggatagagcaatcgcagtttcccctgaaaggaagagtaagaagctcattctgttgattttttatctacgtacttttatctagaggaaagattcaagttgtttctttcaggttactgatgtgattgtattatctaaatatcattcttcttctacacatgcattgattttagaagaggtataatatgatccttggtttgaaatatttaaagagtttcattattatctttcaggttgactaaactcctgccagcatgtcttgccagcaaaaccagcagcagtgccagccccctcccaagtgtcctcccaagtgtaccccaaaatgtccacctaagtgtccccccaaatgcccaccacagtgcccagctccatgtttccctgcagtctcttcttgctgtggtcccagctctgggagctgctgtggtcccagctctgggggctgctgcagctctggggctggtggctgctccctgagccaccacaggccccgtctcttccaccggcgccggcaccagagccccgactgctgtgagagtgaaccttctgggggctctggctgctgccacagctctgggggctgctgctgacctgggctacagaagagctcttgggactgaatggccaagaacctgctacggcctgatggatactctttccacttcctctcattccattcattggttggcagagaccacaaagactcatggggctttcctggaagaacttcgtgcttgatgtaacaccccaattgcaagtcttcttttcctcctttacctcatgttataataaagctctgatctctgactcactaaatgtcttggtcattctcttctcttctgagatttcaaatgtcctccaaaggtcagggcctcagagtaattttcttcatgaggctaggacaggacatgagtaggtgatacatgaaaagctgctctgaggaactgattcccccagatgctgagtgaatggagctccaagagggtcacctctggctatggtagctttgcctttctctccactaagccagacacatgttctaattttctgtgtaatccagacgttgggaaggttgggaagctctgcagacttgttcttctctagggagaagaacacatccctatgaagcaaaactttcctgcccttagaatcaatagttggataaaatgcttgaaacagatgttgagacccttcctcctgtaaagtacagcccatggtcactcagcttcttttcatgagtctggttaagatcagccttttgacttgctgccttggacacctggcttcagttcctcacagtgttagatctgagtcccaggatgctgtcctgccacttggctcacgtgctgggcaggggagtgatgagtgatggagatattaagtgaaaaaacatggaagtgttgcttagaagatacaaagaatataaggaacataagaatacaaagaatacaaaacgctgtatgaaagaatagacctttcctccttcaatacttatcttttttgccaagccaccctcagaatgtgaggggggagaagcgccaggatgggtggggcatcttaagtattactagaggaaggggagggaagcagggacacagcaggggaaacaagggctagtgcttcttaggttcaggctgacaggtgtcgacatgaagataatggattcagcaaagacggattttgacagagatggagcctcttattaatatgtttaccttcttacttacccttagtgccactaagacaaaaacccagctgattaaccagtttgagattctgtactgtctgcattttaaatcaccctctgcactgagtcagtttatttgactcaatgctctttattattttgccagtctcattattaactaattttcaagtccctgaccagtagtaattttgagcttccataaatatgtacattggctatttctacaaaatttgtaataggattttaaattttcttttcaattttcaagagctcttgatatatcatggatattaaccttgatctgtctttattaaaatatttaatacatcataattaattgactctgtttataataacttttgctatggaaatatttgtagtttttaaatactcaaatatgactttctttgctttcatagcttcagggtttcctgagttggttaagaagtttttccttgtccttagtgtttacatgtcagcaaacaaaacaaataaaaaaacccaaacagtataaaatggaacaccaagcgggggacctaaggttgcctggggcaggtgaaggctggcctgcggaggggtggacacccgagtatgctttcagggacctctgccttaagtaagagcaactcaccggccctttccttctccagtgggcctgctatctggggctccatgtgctcctttcatggtgaacataatcctttccttatctaaacttccatacacagaataatttccaatctgactattggtttttacttgcatcttatcttatgtttggcatgtgtgcatgtgtgttagaaattaagttctgctactatcacaggaactcaaaatcacagcaatttaaagaggagagcaggctatttccactcacatgtgattaagtcagaggtcagtagtccatggctggtatggtggttccctggagtattcagagatggatacccctctgtcttgtcatttcattattagtgcttatttcctgagaaacagttggtgatctcaagatgcctgatggagttctgatctgcaacgctgtacttcaggtctgaagaaagagaaagggtgggtgaaaggtcctgatcccaatagagcctcttacctgagctttcctaaagtcccaacaatttcctaaatctcactggctgcttgtatgtacagaagggatagagaagtataaattttgatatctggacatggtgtggttctggacaaaatttaaagatgtaagttaagaatgaagtggagcacgcacattgcgtacacatccaatcaagtagttcttgatatagttcaacctgctgagtaaagacagctggattgctggtttctggaaatagcgacacagactctctgggtacacttcacttacctcttaatgcaacattcaggaacgtcctgcccacgtttccacctttatggtctctgctgtatgcactgaggcaaatctgcctggaaggttgattaggcaggggaattcactgcctgcagctgaggtctggagtgctctggggggctccctggagacaggcacaagacctggcttatggaagcctggcggaggctccaggttacttctgcctcctgtctccccacctctaatccacccatcacccagaagtgggccaaggatcaggggtctggatcatctctcaagggcaggaggagggtgaggctctgagaagaagtgtgctgtccaatcagaaaccatacttggtgttatggctgcatctctttcaaaggtatctagagtgggagggtgacagatgattaactctgggttatctgaaatatgacccaagtgaggagagtcaacagtaaccagaacacattgtgaaaaggaaaaggtggatagattgtcacctgggccagaatccccagagagcactttcacctccacatcgaatgaaaaattctacctggtcaccctcttgagtccccagagggtcagcccaggaatagggtagagtagaaaggagttttgggccaggatggatgcttgtgtgtgtggttatctcaactcggaccctctgagatccacagcagtgcccgagagctgcgacgctgctctctcactgactctccaggctctgtcgctgctgctgcaacagctctgcagccaaggtctgctgactgtgttttgcctgtgctaactccaggagcagctgctcccagagcaggaccaacactaaccccagtgctaagaaaaactccagagcctgagggaccagcatattggccggctcttggagggactcttactgttgctggctcagttggcaggatatcttaacatgagttcagctggaagtgaattcagctgaacagaacacatgtgtaaactagaataaggctacttttcattttctaaacaattctccttctgcttgtaaataattggcaaacccactaatattcagaaagaaattccccatgttaccatttcatggttgctccttgaccttgctaggtcagatttcaatcctagtccacccccacgctggttgcattgctccatcttcacacctaattcagaactatgtacagaaagagtaaaactatgtaattctaaacttttgtgctagttataagatatgcactcttataagtgtttcaggtgtaactcaaccaaaataacaattaattcacacaatattgctgttaggaaattacagctattttccacacttcatagatgaaaagacagatgcacagacaatttcgggcacatttctaaggctttaaggcaagtaacttgttctcagaatccaaatctaggtgatttaactacattctgtggtctcaacaagttctctggagttaaactgggaaggcatgcactatttactgtgtgtgaaattcaaacagcttatggtaagttcttctcaacaagctagacttaaaacagctattcccttcttttcttgcctgatatactaatgtttctgtgttagttcccacactgcataaaatgagcctctatttctcatgccctcttcatccacgtccctccctcctttctgaagaatatagtcacagtgggcagatattatattcctttcatatcatgtagtatccccagagttggccacatagtcaacaatacttgctgagtgtgtataagagtgaattaataaactctgattattgaatttactaatgggagacagtccaagaaaatcctcaaattgttttctctttagagatgttcttttcttttaattcatctgatcatatccttctctcatttactcttgtaagaactgcttaatagttacctaatttgctcagcacagaattcttggaaaagttccttgctccagggaatcctaaggcatggatatgcagtgattgcaaatagaatatttaattaatgtgcactattcatctaacactgacattcttctaattccaatgattagaaagaaatactggatataaatggacataggcagtgagggtgttggtgtgtgtgtgtagtgatcatatgtaattaacataattttctcccatgatagcctataaatagtgctgtctgggtcatgaaaaacgatgggttcagtcttggttttgattaagaagtaagtgcatagatattgcatataagagaggtacacagacaatgttggcagggaattggtatgggagagggatttagaaagcatagttataaattatctggaaaattcatcccaccaaacaaaataattgacaatctggactagacagatggtctgacattgtgtgtgtgagtgtgtgtgtgtgtgtgtgtgtgtgtgtgtatggtagtgtatctatgctgtgtgtaaacttgttgtcagaaacctgttgacattatactaaaataattgaaatttttttggttaaattttctgaactttattcccagctgtgtgaacttgggctatttgtttagctctaggagcctttgttttctcattagtacagtgggaatattaataccacctacatcacatgattagtatgaggattaaatgagataatgtgtataaaacacttaaataatacctagaaaaaaatagatggtcagtaaacatcagttattatattactttctgttatttttatcattgtacacacatgtatgtatgcatgtatacacacacacacacacacacacacacacacacacacacggaggcatttgacccaaaagcacaactccactcaacctatacctcagggaaagatggggaagtaggtagacctgaattggctagggttttgcagagaaacagaagagagagataaatttattttaagaaattggctcatgagatgactgtgtgggctggcaagtccaaaatcttggctggaaattcagataacagttgatgttgcagcattgagtctaaattctgcaacgcagtagtctggaaacaggcagagtttctacattgcagtcttgaggataatttattctttgggaaacctcagtgtccattattaaagactgcagctgattggatgaggctcatgttagggaagataatctgcttactcagtctactgattaaatacttacagagaaacatgtggattgctatttgatcaaacaactgggtaacacagcatagcctgggcaaaattaaccatcacagagactgagaggatacatggaggtcactggagatatgacccaagagacagaagagggtcaacagtgacgaggacacactaagaacatgccatgatggttttattttcacttaggataaaggcaaatttctggacagacctttggagaatattgggaaaacagaagcttctacctggtaaccccatggtaagcccaacaaagctgtgatgttaggaggactggagaaagggagtgcagcatgcggctgaggaggcccttggccttcgcactttggtttcacagaagtgtagtcagtacagcacggacaaggctgctgaccactgcacagtagctggagctctggggactggtgattgctgcagcttcttcctatgcaggggtcacacaagaagattcggaggtgaacatgggctgtgcactggagtggcactgtggagggccctttgaaggcattggcattgctggtggttttttggaaaggtatctgagtttcagaatgaattgaataataagtcagataaattagagccaggacgggcataattttgcccttttaaacctattcttggtgtgctggcagacagtttataaaatacatttgtatcgaattagtacctatgaagaaacgtataaccccaagttaaaagtgttagaactgacatgcttaaaaacagaattaatgctaaatcaatgtcaattctgtctctcatttcatttcatatctacgtacccacttcctacctacagtatttcatgagctttaagaggctatcaattgtaagggacacccttatttcatgcaccacaaggaaagaaaaaaatgctgcaaattcaacaattacgtgccaccaatcatatggtatatactgatttaagggctgttaacaagtattagaagactgtatcatggaattgatgaattaagataagtataaaaccgatccactttaggtcatataaatatgtatgtaaatactagacgggccaattcttgctttgcccagaacacccctctgctgtgctcctccctatcactatgtctagcactagacactgctagacagtattgacaaaaaagatcaaaaggcctacaaagatatggtacaggaaaattttggattggtcaatctattaaataaagggagacaaataaaaagacatggtaaggctttttcttgtactgtagataaaataaagttcccacatttggtagggagtatttttctggaatatatggagtttaagttcccagggagacaaatcaaggagctacttggagagaccagcctgcaggagagtgacttgccagatgacatgaacttcagatgaaatgtttgaagtcacccgcagggcattcttctcatgacacctacatgctcgtccatgtggtcctaaaatgatgcactgatcctgccaacactcatgtggcaattaagtatgtgggtggtccctgagggagcatgggcaatgtgacccactgggtctcctggctcagagagatcacacatgatgatgtgaagactgtggagacagaagcaagaatatctatagtcaggtgtttcttcactgacttgtgaaccaattcccaccattttttgagatataaagggaaaaagtgggcatgttaaagagctgtttatctcccagttctggtttcccagagggtcggttcccattagtccttccattgcttattcaaccactcaatacagatgctcatgtatgtgcatgttcatttcacctgcacttttatatgaatacagcatacatgcacacagtgcatacatgcacacagtgcacacatgcacacacacacacaggcttgcctcccctatttcctcacttacaacattgtaacaaatatctttgtcaaagagtatgaggaagctgagggtgatatcaccatgaagacagtggaatgaactaacatcttttaaacacattgggaaatagtgactcaggaggttcaggcctcaaacatcatcttctttggtatccagtttgtctgcagtcatcttcaaaaaggccactaaattctacagtctttgaggtcatgggctacttattgttcacctctatatccctatgtttggacatacatgctccaagaatgttgtaggctttcaaagaatgccttttgaattcactgctctaatcacactgtggacttagtttatccttgaggtaaaagctctctgagaacaggactcgggtctgaaaataggactgtgtaaataggtgaatagaatccctcaggtagaagcagacaatgggaaactatgctttctacctaaccaccctccaccaccaagtaaacattaggcaatgtcaaggcacggtctgtttctgttttaatcagaggtgtgaataactatctttttcaattctaatttcaacatcttcattgagccataattcacttattatacagctcatttatttaaagtgttaattcagtgggtttcaatatattcatagagttggacaatcaccaccaaattttagaacattttcattactccacaaagaaaacctatatccatttgttgtaattttctaatttctcccagcctgctaaagtacctggaagccactgatatttcctcagaggatgtgcacaaaagtaaaaggcgatacagggaacagaatcttgtccaggctctggttcctcagatgccctaagtcagctcttcaggcgtccagcctgagagaggctgtaactggctaaagcctcattccctttctagttctacagatttgcctactctacacatttcatataaataggatcataagaaatgcagtcttttgtggttggcttcttccatttagcgtaaggttttcaaagttcatcctccatatatctgtttaaaataagtgaataaatgaatgggtaactctgtctagtgcaaccctgaatcagaactctgagtaagtagacccctttctgaccctctacttcatgataggaaaggaattccctctccacagaagccacaataaatgatgtctacttcctaagggagttttcaaataaactgtcttgtaagggttctatatggacaatgaatgccacataagacctgggtaagtatccaatacatggcattagtttttcttttaaacacatatttattaagggtctatcaagcacatagtgtcacactaagctctttcttacttctcatttaatattaaaaacagctcagtgagataagtatacctggtttataacggccattacatatgagaattgatactcattgtgagtatcatagtgacactctagcaattgttgataattgttgtagcaatttccagagatcactcagttatcatatgcaagttttctgattccagtagcacattcaatacaattcctccgactaagggcaatgttttgattttagagggaattgtttattctcaatcatattctttgctctagaccacagaatcaactcagatttaatccactgaatctgctggccatggtgagttggaggaaaagcagaaacacagaggccaggaggaagggctgagagcctaggcaagggagggatgcctagaaaaagccaaggctgtagaagccccctgggatggctggatccacagcaggacatggaagagaaactgctcagggtggagggagtcataatggaacatttccacaaggtcagggaaagctgtggctcagaactgatgtttcctcagaggacacgaatacaaaagatgcagggaacaggatcttgtccaggcatgggtcccttgggtaacctaagttaactcattagggttcccacctggtggaggctctgactggctaaagcttctctagaccgcagccccagagaggagtcctggaagctcctgaggcctctttggattgcagggactaggaggcaggagaatgtcaggaatgacccagcacgtgcctggttgtgcaaaagccacctcctcctctttccagagccaagcctgggccctataaaagacacatccagcttcagcacctcatctgctctgactccccagggacgtgtctgtgctcctgcgtgtgaccagggtgagtggcaacctgggataccagaggggtatgagcaaggcagagggatggggaggatggaggtaggctggagaaagagttgtgtgcttgtgttctgccatactgaggaggaatgggactcagtctgcctcgaatctgttgaggctgtgaggcctaccggaggtcgtataggtggggaaagctaactgtgcacatcttttccaattctgtgttcagtgacttcatgttggtaacttcaaaactgctgtgttgggcatatttacaccatggaaactggcaaatacttcaagccaggctcttttatctggaggtttcattgcaaaatctttttccagaggacctcctggtgtgtcctgcaacacgcagctggtccttagggcttgtattaagggaatcggtacttcatggagtgtgaatactctattcaggcttgtgaggatagagtaatctcagcttcccctgaaaggaagaatacgaagctcattcggttggttttttaatgtatgtgcttttatttagaggaaagattcaagttgtttctttcaggttactgatgtgactgtatgatctaaatatcattcttcttctacacatgcattgattttagaagaggtataatatgatccttggtttgaaatatttaaagagtttcattattatctttcaggttgactaaactctgccaggatgtcttgccagcaaaaccagcagcagtgccagccccctcccaagtgtcctcccaagtgtaccccaaaatgtccacctaagtgtccccctaaatgcctgccccagtgcccagctccatgttcccctgcagtctcttcttgctgtggtcccatctctgggggctgctgtggtcccagctctgggggctgctgcaactctggggctggtggctgctgcctgagccaccacaggccccgtctcttccaccggcgccggcaccagagccccgactgctgtgagagtgaaccttctgggggctctggctgctgccacagctctgggggctgctgctgacctgggctaagaagaactctttggacagaatgtttaagaacctcctacagcctgatgcttaaccctttccatttcctctcattccattcatgggtggacagcgaccacaaagactcatggggcttccctgggagaactttgcacttgatggagcacctcaattgcaggttttgttttcctcctttacctcatgttataataaagctctgatttctgactcacaaattgtcttggtcgttctcttctcttctgagatttcaaacgtcgtccaaaggtcagggcctcagagaaattctcttcatgggtcaaggacaggacctgagtaggtgatacatgaaaagctgctccaaggaactgattccctcaaatgcagggtggatggagctcgaagagggtcacctctggctatggcagctttgcctttctctccactaagccagacacatgttctaattttctgtgtattccagacattgggaaggttgggaagctctgtagacttgttcttctctagggagaagaacacatctctatgaagcaaaacttccctgctgttagaatcaatagtcggataaaatgcttgaaatgcatgttgagacccttccttctgcaaagtacagcccacagtcactgaactccttctcagggagggtgagtctggttaagatcagcccattgacttgctgcctcagacacctagcttcagttcctcaaagtgttagatctgagtcccaggatgctgtcctgccacttggcctatgtgttgggcaggtgagtgatgagtgatggagatatttattagaaaaaacatggaggtcccactttgaaaatacaacgaatttatggtacacgacactgtagggaagattagacgtttcctccttcaatactaaccttctttgtccagccaccctcagatgtgaggggggagaagtgccaggatggttgggggatctttagtattaatgggagaaggggagagaagcagggaaacagcaggggaaataaggactagtgcttcttaggttcaggctgacaggtgtcaacatgaagataatggattcagcgaagagagaatctgacagagatggagactgttattaagatgttcagctgcctcctcatccttgcagctgctaagaaaaacacctagctctttaaccagtctgagattctgtactctctgtgttttaaattagcctttgcactgagtcattttatttgatgtaatgctctttattatttttgccagtctcattttattttattttttttacttaagttctgggatacatgagctgaatgtgcaggtttgttacataggtatatatgtgccatggtagtttgctatgtctattaacccgtcatctaagttttaagctccacatgcattacgtatttgtcctaatgctctccctcctctcacctccacccccaatatgccccgatgtgtgatgttccctgccctgtgtctatgtcttctcattgctcagctcccacttattagtgagaacatgcggtgtttggttttctgttcctgtgttagtttgctgaagatgatggtttccagcttcatccatgtgcctgtaaaggacctaaacttattctttttatggctgcatagtattccatggtgtatatgtgccacattttctttatccactctatcattgatgggcatttgggttggttccaagtctgctattgtaaatagttgtgctataaacataagtatgcatgtctttatagtagcataatttataatcctttgggtatatacccagaaatgggattgctgggtcaaatagtatttctggttctatatccttgaggaatcaccacactgtctcccacatgggtgatctaatttacagtcccaccaacagtgtaaaagcattcctatttctccgcatcctcttgagcatctgttgtttccagactttttaatgatcgccattctaactggtgtgagatggtatctcattttggttttgatttgcacatctctaatgaccagtgattatgagctttttttcatatgtttgttggccgcataaatgtcttcttttgagaagtgtctgttcagatcctttgcccactttttgatggggttgtttgtttttctcttgaaaatttgtttaagttccttgtagattctggatattagacctttgtcagatggatagattgcaaaaattttctcccactctgtaggttgcctgttgactctgatgatattgtcttttgaaaagattaacaaaatagatagaccactagccagactaataaagaataaatgagagaagaatcaaatagacacaataaaaaatgataaagcatatatcaccactgataacacagaaatacaaacaaaccaccatcaaagaataatataaacacctctatgcaaataaactagaaaatcttgaagaaatggataaatttctggacacagaaaccctcccaacactaaactaggaagaaattgaatccttgaatagaccaataacaagttctgaaattgaggcagtaattaatagcctaccaagcaaaaaaaaaccccaggaatagagagattcacagtcgaattttaccagaggtacaaagaggagctgataccattccttctgaaactattccaaacaatagaaaaagagggactcctccctaactcatttaatgaggccagcatcatcctgattttaaaatctggcagagacacaacaaaaaaagaaaatttcaggccaatatcactgatgaacatcaatgcaaaaatcctcaataaaatactggcaaactgattccagcagcacatcaaaaagcttatccaccacattcaagtcggcttcatccctgggatgcaaggctggttcaacatacacaaatcaataaacgtaatccatcacataaacagaactaatgacaaaaaccacatgattatctcgatggatgcagaaaaggcctttgataaaattcaacactgcttcacgctaaaaactctcaataaactaggtattgatggaacatatctcaaaataataagagccatttatgacaatcctgtagccaatatcatactgaatgggcaaaagctggaagcattccctttgaaaaccagcacaagacaaagatgccttctctcaccactcctattcaacatagtatcagaagttctggccagagcaatcaggcaagagaaggaagtaaaggttattcaaataggaagagaggacatcaaatcgtatctctttgcagatgacatgattgtatattcagaaaaccccatcgtctcagcccaaaaactccttaagctgataagcaacttcagcaaagtctccggatacaaaatcaatgtgcaaaaattacaagcattcctctacaccaataatagacaagcagacagccaaattatgagtaaactcccattcacaattgctacaaagaaaataaaatacctaggaatataacttacaagggaggtgaaggaattcttcaaggagaactacaaaccactgctcaaggaaataagagagggcacaaacaaatggaaaaacattccatgctcatggataggaagaatcaatatcttgaaaatggccatactgcccaaagtaatttatagattcaagctatccccatcaagctaccactgactttcttcacagaactacaaaaaactactttaaatttcatatggaatcaaaaaaagagcccatatagccaagacaatcctaagcaaaaagaacaaagctggaagcatcaagctacctgacttcaaactgtactacagagctacagtaaccaaaatagcatggtactggtaccaaaacagatatatagaccaatggaacaaaacagagaccccagaaataacatcacacgtctacaaccatctgatcttcaacaaacctgaccaaaaaagcaatggggaaaggattccctatttaataaatggtgctgggaaaactggctaatcatatgcagaaaacagaaactcgaccccttccttacaccttatataaaaattaactcaaaatgggtgttaaagacttaaatgtaaaacctgaaagtataaaaaccctagaagaaaacctaggcaatacaattcaggacataggcatgggcaaagacttcatgactaaaacagcaaaagcaattgcaacaaaagccaaagttgacaaatgggatctaattaaactaaagagctcagccagtctcattattaactgaaatttcaagtccctgaacagtagtaattttgttcttctaaaaacacgtacattggccatttctacaaatttcataacatgatttcaaattttcttttcaattttcaagggctcttgatatatcacagatattaaacttgatccgccttattaaaatatttaatgcagggacccacttgaggaggcagtctgtgggtccctgacccccgagtagcctaactgggaggcaccccccagtaggggcatactgacgcctcccatggtcgggtactcctctgagacaaaacttccagaggaacgatcaggcagcaacatttgctgctcaccaatatccgctgttctgcagcctctgctgctgatacccaggcaaacagagtctggagtggacctccagcaaactccaacagacctgcagctgagggtcctgactgttagatggaaaactaacaaacagaaaggacatccaaaccaaaaccccatctgtacgtcaccatcatcaaagaccaaaggtagataaaaccacaaagatggggaaaaaacagcagaaaaactggagattctaaaaatcagagtgcctctcctcctccaaaggaacgcagctcctctctagcaacagaacaaagctggacagagaatgactttgaggagtggagagaagaaggcttcagatgatcaaactgctctgcgctaaaggaggaagtttgaacccatggcaaagaagttaaaaaccttgaaaaaaaattagacaaatggctaactagaataaccaatgcagagaagtccttaaaggacctgatggagctgaaaaccatggcatgagaactatgtgacgaatgcacaagcctcagtagccaattggatcaactggaagaaagggtatcagtgatggaagatcaaatgaatgaaatgaagtgagaagagaagtttagagaaaaaagaataaaaggaaatgaacaaatcctccaagaaatatgggactatgtgaaaagaccaagcctaagtctgattggtgtacctgaaagtgatggggagaatggaaccaagttggaaaacactctgcaggatatcatccaggagaacttccccaatctactaaggcaggccaacattcaaattcaggaaatacagaaaacgtcacgaagatactcctcgagaagagcagctccaagacacataattgtcagattcaccaaagttgaaatgaacgaaaaaatgttaagtgcagccagagagaaaggtcgggttacccacaaagggaagcccatcaaactaacagctgatctcttggcagaaactctacaagccagaagagactgaagaccaatattcaacgttcttaaagaaaagaattttcaacccagaatttcatatccagccaaactaaccatcataagtgaaggagaaataaaatcctttacacacaaacaaatgctgagagattttgtcaccacgaggcctgccctaaaagagctcctgaaggaagcactaaacatggaaaggaacaaccggtatcagccactgcaaaaacatgccaaattgtaaagaccatcgaggctaggaagaaactgcatcaactaacgagcaaaataaccagctaacagcataatgataggatcaaattcacacataacaatattaaccttcaatgtaaatgggctaaatgctccaattaaaaggcacagactggcaaattggataaagagtcaagacccatcagtgtgctgtattcaggaaacccatctcacgtgcagagatacatataggctcaaaataaaaggatagaggaagatctactaaggaaatggaaaacaaaaaaaggcaggggttgcaatcctagtctcggataaaacagactttaaaccaacaaagagacaaagaaggccattatataatggtaaagggatcaattcaacaagaagagctaactatcccaaatatatatgcacgcaatacaggagcacccagattcataaagcaagtccttagtgacctacaaagagacttagactcccataaaataataatgggagactttaacaccccactgtcaacattagacagatcaacgagacagaaagttaacaatgatatccaggaatttaactcagctctgcaccaagtggacctaatagacatctacagaactttccaccccaaatcaacagaatatacattcttctcagcaccacaccacacttattctaaaattgaccacatagttggaagtaaagcactcctcagcaaatgtaaaagaatataaactataacaaactgtctctcagaccacagtgcaatcaaactagaactcaggattaagaaacacactcaaaaccactcaactacatggaaactgaaaaacctgctcctgactactgggtacatatgaaatgaaggcagaaataaagatgttcttgaaaccaacgagaccacaacatactagaatctctgggacacattcaaagcagtgtgtagagggaaatttatagcactaaatgcccaaaagagaaagcaggaaagacctaaaattgacaccctaacatcacaattaaaagaactagagaagcaagagcaaacacattcaaaagctagcagaagacaagaaataactaacatcagagcagaactgaaggaaatagagacacaagaaacccttcaaaaaatcaatgaatccaggagctggttttttgaaaagatccacaaaattgatagaccactagcaagactaataaagaagaaaagagagaagaatcaaacagacacaataaaagatgataaaggggatatcatcaccaatcccacagcaatacaaactaccatcagagaatactataaacacctctacgcaaataaactagaaaatctagaagaaatggataaattcctggacacatacaccctcccaagactaaaccaggaagaagttgaatctctgaatagaccaataacaggctctgaaattgaggcaataattaatagcttaccaacccaaaaaagtccaggaccagatggattcacagccgaattctaccagaggtacaaggaggagctggtaccattccttctgaaactattccaatcaatagaaaaagagagaatcctccctaactcattttatgaggccagcatcatcctgataccaaagtctggcagagatacaacaaaaaaagagaattttagaccaatacccctgatgaacatcgatgcaaaaatcctcaataaaatactggcaaaccaaacccagcagcacatcaaaaagcttatccaccatgatcaagtgggcttcatccctgggatgcaaggctggttcaacatacacaaatcaataaacataattcagcatataaacagaaccaacaacaaaaaccatatgattatctcaatagattcagaaaaggcctttgacaaaattcaacaacacttcatgctaaaaactctcaataaattaggtatcgatgggacatatctcaaaataatctaagagctatctatgacaaacccacagccaatataatacctaatggacaaaaactggaagcattccctttgaaaactggcacaagacagggatgccctctctcaacactcctattcaacatagtgttggaagttctagccagggcaatcaggcaggagaaggaaataaagggcattcagttaggaaaagaggaagtcaaattgtccctgtttgcagttgacatgattgtatatctagaaaaccccatcatctcagcccaaaatctccttaagctgataggcaagttcagcaaagtctcaagatacaaaatcaatgtgcaaaaatcacaagcattcttatacaccaataacagacagccaaatcatgagtgaactcccattcacaattgcttcaaaggaataaaatacctaggaatccaacttacaagggatgtgaaggacctcttcaaggagaactacaaatcactgctcaacgaaataaaagaggatacaaacaaatggaagaacattccatgttcatgggtaggaagaatcaatattgtgaaaatggccatactgcccaaggtaatttatagattcaatgctatccccatcaagctaccattgcctttcttcacagaattgggaaaaactactttaaagttcatatagaaccaaaaaagagcccgcattgccaagacaatcctaagccaaaagaacaaagctggaggcatcacactatctgacttcaaactctactacaaggctacagtaaccaaaacagcatggtactggtaccaaaacagagatatagaccaatggaacagaacacagccctcagaaataatgctgcatatctacaaccatctgacccagcatgcctagatattcttgatattcttttctcctcttttatctctttggaaaatcatgggagattccaggataccccaccagtttcttctgctcaaaagttataaatggcttcagcaggaatctagccactgggcaatagtttcagggacccagttcactatggagtcaactcttgttacgaaacttggttctcacctcacctccaggtctgctctatgagctggtggcttaggactgggattgtctgttttcagagggaaggagaggttgaaatgagctaagagatgtgttttacaacaagaaactataaaataacctactgcttgcagaagctgaaggagagggatgagtgacattggtaaggtcccatgcctggtgaataagagaggaaataccacaaagagagagcgtgttttggagatcaggaggttttgtgatagagttagtttgaggtcacagcaaaaatatttgcctcttagaagacatttggcaggatcaaactgcaggtcagtgactttctaggcaaagcagaggtggcttaaaggaagtattttaaataactcccaggtaattcttctaataacatttaatttattcattcatccatctaatcaatagtctatggtcaactgctagactccccaggaaaagaaacaatgggtaagacctgattctgagctcatgctctggtgacttaatatccgtggacatagagccaagattgtctagaattcttactggtgtcaaaggctgtaagcctgatctctaacagtgactgaccatattttatcataaaaaatatggaaggacattttgtctgctgagactggcttcctgtgaacgaggcacatatcagctttggagtcttctctccaacccttggccacgctgctgtgcttgtccctggacttgcaagcacaccttcatgcccatgctgcccacacacacatacacacacattcataaaggcacagcccatcccattctcttccttcatggttactatcatctttgtcaaggagaatgaggaacctagcatgacattccctcaggcattatcaggtgatccagtgtcccaacaatctcattggaaaatag

SEQ ID NO: 279 - DNA, 34 bp, Homo sapiens
tctcaacttttgaaggtatatttgtaaaaataat

SEQ ID NO: 280 - DNA, 10760 bp, Homo sapiens
acaagaaactataactacaacaagggatgtattcagtatgatctagattagcatgtggttttaaaaaataaacaaatgagccctcatcttttattatagggaattattactatctgaaactaaagcatatagttagaaatggcctccattactctttatttttaccttttctctcaatttttaaatttatttttaatttttgtgagtacaaagtaggtatatatatttatggggtacatgagatattttgatacaggcatgcaatgtgtgataactaaatcatgaaaaatttggaacacatctccccaggcattacgcttttgtgtttcaaacaatccaattatattctctagttatttttaaatgtacaattaaattataattgactatagtctctgggttgttctatctgacactaagtcttattcattctttctattttcagtacccattaaccattcccaccactccacccacactccccactatacttcctagcctctggtaagcattcttctattttctatctccatgagtttaattgttttgatgtttagatcccacaaataagtgataacatgcaaagttcgtcttgctgtgcctggcttatttcacttgacaaaacaatctccagtgccatccatgttgtcacaaatgacagaatcttatcctcttttatgattgaataatacttcattatgtatatgtaccacattttctttatccattcatctgttaatgaatacttaggttacatccaaatcttggccattgtgaacagtgctgtaacaaacataagagggcagatatctcttggatatatgggtttctttttttactttttaaattgttgtgggcacatagtaggtgtatatatttatggggtacatgaaatgttttgatatagacatgcaatgtgaaataagcacatcatggagaatggagtatccatcccttcaagcacttattatttgagttacaaataatccaataacattctttaagttattttaaaatgtacaattaaagttattattgactatagtaaccctgttgtgctatcaaatagcaggtcttatgtattatttctaactattttttggacccattaaccatcccacctccaccccaccccaccccaccccaccccactaccctttcaagcctctggtaattatccttctattttctatctcaatgagttcaattgttttgatttttagatcccacaaataagcaagaacgtgctataattgtctttctgtgcctagcttatttaacttaatgtaatgatctccagctccatccaagttgctgcaaatgactggatctcattctcttttatggctgaatggtactccattgtgtatatgtatcacattttattttccattcatctgttgatggacccttaggttgcttctgaatcttagctattgtaaacagtactgcaacaaacataagaatgcagatatctcttcaatatactgatttcctttcttttgggtatacacccagcagtgggattaatgggtcgtattgtagctctatttttaactttttaaggaacctccaaactgttctccatagtgtttgaactaacttatgttcccaccaacagtgtacaagggttcccttttctccacatgcttgccagcaggctttattgcctgtcttttgtataaaaattttatttgtggctattacaaatggaattagttttttatttctttttcagattgttcactgttggcatatagtaatgctagtgatttttgtatgttgattttgtatcctgcaacttactgaatatgtttatcagttctaatagtattttggtggtcttcaggtttttctaaatttaacatcatttatccacaaacaaggattatttaatttcttcctttccgatttggatgccctttacttctttatcttttttaattgctctaaaacatacagtactatgctgattaacagcatagttatgtttcaggtttaagagggcaaacttttaggttctccctattcagtttaatactagctgtgggtctatcatagatggcttttattatgttaagaccttctatacccagttttttaaaggttttcatcatggagggacgttaactttatcaaatggtttttcagcatcaattgaaatgatcatatggttattgtcctttattctgttgatatgatgtatcacattgattatggccattctttcaggaggtggtatcacattgtggttttgatttgcatttacctgatcattagcgatattgagcattttttcatgtgtttgttggccatttgtgtatcttcttttgagcattgtctattcatgtccttagcacactttttgaagggatttttttctttttttactgatttgtttgagttcattgtacattctgggtattagtcctttgtcacatgtatagattgtgaagattttctcccagtctgtgggatatctgtttgctcttctgactgttccttctgctgagcaaaaactctttagtttaattcggtctcagctatttatctttgtttttattgcatttgcttttgggttcttggtcatgaaatgcttgcctaagccaatgtctagaagggtttttccaatatccccagtgagttttgattatggctataatcataaaacagtagatgttggcatggatgcgttgaacagggaacacttctacactgctggtgggaatgtaaactagtacagccactatggaaaacagtgtgaagattcctttaagaaccaaaagtagaactaccatttgatccagaaatcccactactgggtatcaatcttctagggtttttatagtttcccatcctagatttaagttcttaatccattttgatttgatttttgtataaggtgagaaatgaggatctagttttattctccaacatgtggctagccaattatcccagcaccatttgtttaaaagggtgacagtgatagtttgccttcgtctttactgatttggatgccctttgtttctttctgttgtcttattactctggctaggacttcagtactatgttgaagaagagtggtaagagtagacatcctggtcttgttccacttctcagaggaaatgctttcaacttttccccagatggcttttttacattaaggtatgtcccttgtttgctgattttgccgagagttttaatcataaagggatgctggattttgttgaatgctttttctgcatctattgaaatgatcaggtgatttttgttttaattctgtgtatgtggtgcatcacatttattgacttgattatggcaaaccatccctccatccctggtataaaatctatttgatcaaggtggattatctttttgatatattgttggatttgattagctagtattttgttgaggattttagcatctatgttcatcaaggatatcagtctgtagttttcttttttggttatgtcctttcctggttttggtattagggtgatgctggcttcatagaatgaactagagagggttgcttctttctctatcttgtggaagagtggcaaaaggattggtaccaattcttcttcaaatgtctggtagaattctgctgtgaatccgtctggtcatggacccttttttttgataatttttaaattaccatttcaatctcactgcttgttattgatctgttcagggtatctaattcttcctgatttaagctaagagggttatatttttccaggaatttatccatgtattctaggttttctagtttatgcgggtaaagctgttcttagcagccttgaatgatcttttgtatttcagtggtgtcagttgtaatatctcctgtttcatttcttagtgaggttatttggattttctctcttcttttcttggttaatgttgttaatggtctatcaattttatttatcttttcgaagaaccacctgtttgtttcatttatcttttgtattttgttcatttgtttcaatttcatttcgttctgctctgatcttggttatttcctttcttctgctgggtttgggtttggtttgttcctgtttccttagttccttgaggtgtgaccttagaatgtcagtttgtgctctttcagtctttttgatataggcgttcagggctatgaactttcctcttagcaccacctttgccttaccccagaggttttgatacgttgtgtcattattgtcattcagtttgaagaatttttaaatttctaccttgatttcatttttaatccagtgctcactcaggagcagttatttaattttcatgtatttgtatggttttgaagattgcttttggagttgatttccagttttattccactgtggtcagagagtgcttgatataatttcaatttttaaaaaatttattgaggctcattttatggcctattttgctttttaacttgtatttttgttttataagtcctgtgtgaattaagctttaaacaggttctgttttgatgtgtttctagggtttgtttcaagatttagagctctttttagcagttcttatagtggtggcttggtaatggtgaattctctcagcatttgtttgtctgaaaaagattgtatctttccttcatatatgatgcttagtttcactggatacaaaattcttgtctggtaattgttttgtttgagaaggctgaagatagggccccaatcccttctagcttatagggtttctgctgagaaatctgctgttaatctgataggttttcctttataggttacctggtgcttctgtcttacagctcttaagattcttccctttgtctcaactttggataacctcatggaaatgtacctaggtgaagatctttttgcagtgaatttcccaggtgttctttctgcttcttgtatttggatgtctaggtctctaggaaggccgggaagttttcctcgattattccccaaacacatttttcaagctcttagaattctcttcttcctcagaacaccaattattcttaggtttagttgtttaacataatctcagacttcttggaggctttgttcatattttcttattctttttgctttgtctttgttggattgggttaatttaaagaccttgtctttgagcttcaaatttcttctacttgttcaactctattgctgagattttccagaggattttgcatttctaaaagtgtgtccaaagttttctgagttttttattgttttgtctttaagctatctacctccttgaatatttctcccttcacttcttgtatcatattttgaatttccttgcattaggcttcgcatttctctggttcctccctgattagcttaataactgatcccctgaattctttttcaggtaaatcagggatttcttcttggcttggatcaattgctggtgagcatgtgtgttttctggggggtgttgaagagccttgttttctcatattaccagggaaggttttctggttccttctcatttgggtaggctctgtcagagggaaggtctagggctaaagcctgttgttcagattcttttgtcccacagggtgttcccttgatgtagtactctccccctattcctatggatgtggattcctctgagctgaactgcagtgattgttgtctctcttccgggtctagccacccagagagtctacctggctctggactggtactgggtgttgcctgcccagcatcctatgatgtgaaccatctatgggtctctcagccatggataccagcacctgttccagtggaggtggcggaggggtgcaatggactctgtgaggttcttagctttggtggtttaatgctctatttttgtactggttggcctcctgccaggaggtggtgctttccagagatcatcaggtgtggtagtatgggggaggaactggcggtggtcggggccctagaacacccaagattatatgccatttgtcttccactactagggtgggtaggaaaggaccatcaggtgggggtggggctaggcgtgtctgagctcagactgtccttgggcaggtcttgctgcagctgctgtggggaatgggagtgagggtctgagttcactggagttgtgtacctagaaggattatggctgcctctgctgagtcatgcaggttgtcagggaagtgggagaaagccagcagtcacaagcctcatccagctcccacacaaactgaagggcctgtctcactcccaccatgccccaccacccaacagccctcacacccagatcatttccaggtgtggagctatatgggtttgaaaacttgtcccaggctacccgcctcccaactgcaaaaaaaaaaaaaaaaaaaaaaaagtgggggcgggggcttggttcttcccctacctgtggagtctgcacaccagatttgcaccctcccccaaattctggacagaaggcttcccaccccaatcaaatggttacaaagttcagctagagatttgcttatcactgtgtagttttaccccttgctcttttggatccctgtggtgcaggcaggaatggcctggtaggtgacccaacaagctcccagggcctttctgcttcttcctctacccctgtattttgctcggctctccaaattaactcagctccaggtaaagtcggaaacttctcacgcaaacagaacttcagctttcagcttctccagtggggatgtatgtttggaagagggggtctctctttcccacttcaacagttggggcactcagtttttgtgggtcggggggggcgtctcccaggtcctgcaggagcagtctgctttcttcagagggtctgtgggtcctctcaggatttctggtttgctcttgcagtccatctggaactaaaattcacaatgcgagccagccactgcctgttgctctttctggagctgcaatctagtcctgcctccagtctgccataatctcccgcattctctaaccgtttttgttggaacactttcaataggattggtataagttcttctttaaatgtttagtagaattcatcagtgaaaccatcaggttctgggcttctttatattgggagacatttttggtttgtttgtttgttttgagatggggtttcactcttgttgcccaggctggagtggaaaggtacagtttcagctcactgcaacctctccctaggagacatttttattatggcttcaatctcattgttattggtatgttcaggttttggacttcttcgtggttcaatcttggcaggttgtatatgcctaggcatttatccatttcttctagattttccagtttattgttatataattgccatagtagccactaatgatcctctgaatttctgaagtatcagttgtaatgtcttctttttcatcactgattttatctatttggctcttctctcatttttccttaatctggttaaaggtttgtcaattttctttatcttttcaagaaaccaactttttgtttcattgatcttttgtgttgttttcttccattcaaattcatttatttctgttctgatcattagtatttcttttcttccactaatttgaggtttggtttgtgcttgcttttctagttcttttttttttttttttttttgagatggagtctagttctgttgcccaggcttgagtgcagtgatgtaatctcagctcactgcaaccttcacctcctggctcaagcaattctcctgcctcagcctcccaagtacctgggattacaggcacgcaccactgcgcccaactaatttttgtacttttagtagagacggggtttcacctgcctcagcctcccaaagtgctgggattacaggcatgagctatggtgcctgtcctctggttctttaagatacaggttttatttatttgaagttattttgtttttgtttttatttcatgtaggcacatattgctacaatttctctcctactgctttcattgtatcctataggttttggtatatggtatttacattatcatttgtttcaagaaatttttccatttccttcttaatttatacattgatacactggtcatttgggagcatactgtttaatttacatgtgttttccaaaatttctcttgttactgatttatagttttatttcactgtggtcagagaatattcttgacattatttccaatttttggatattttatgacttgttttgttacctaacacatggtctatctttgagaataatccatgtgcagaggagaagaatatgtattctgcagctgttggatgaaatgttctgtaaatatctattaggtccagttgttctatagtgcatattaagtctagtgtttcttcattgattttctgtcttcaagatctgcccaatgcagaaagtggagtgttgaagtctccagctattattgtattgaggtctatctctctctttagttctaataatatttgcgttatatatctgggtactccagtgttggtatgtatatatttgtcaccattataccctcttgctgaattgacccctttatcattatataatgaccttcttcttacagtttttgtcttgaaatctattgtgtctgataaagtatagctactcctgctcttttttggtttccattgtcatagaatatcttttttccattcctttattttcagttcatgtgtatctttcaggtaaagtaagtttcttataggcaacacatcattgggctttatttttccatccattcagccattctgtcttttaattggagagtttagttcatttacattcaatgttgttattgataaggacttactcctgccatttcattatttgttttctggttgttttgtagtcttctcttctgtctttccttccttcctctcttccttttagtgaaggtgattttctctgctggtatgctttaatttacgctttttatttttttatatcttttgtatgtttttcaatttgatgttcccatgagacttgcaagtaatatgttataacccatcattttaaactgatggcaacttaacactgattacataaacaaagaaatgcacaacatgaaaactaataaaaactctatactttaaactatgaacctgctttttaactttttgttgtttctctttatgtcttactgtactgtctgtgtcttgaaaagttgttatagttactatttttggttgattcatcatttagtctttctacttaagtcaggaaaagtttacacaccaccattacagtgttatactattctgtgcttttttctgtgtttataccagtgagctttatactttcacagtcaacaatctcagcagtttacctgaggttctattctactgcagctaagttggcactcagaccacaagacaaagtccttcccactcttctcttccctttctataggcagaggtctctgtggccttgaccacccctagtccatggggatttctactcggccaccaccaatgtttgcctaaagcccacgggctcttccatcggcttatgatgaatgctgtcaggcctgggactcacccttcaggatactgggctcccatctggcccatgccaggccaagtctagaaatactgttcaagaatctaggtctggacttcaggtccccacgaacctgcttgttgctctattccactgtggccaagctggtagccagggtacaagacaaagtcccctttacttttccctctgctttgcaaaatgcaatttttcatcattttcattgtagttgccacagctgagaatgtgctgggtctcccctgaagccagcacatcttagagtccaaggcctgtggtgtactcccttggtatcactggagattattcagggtctgagggctcttcagttagcaggtgatgaatcctgccaggactgggttctcgtcccttcaaggcagcagattcacttttggctcaggttgtgtcaagaaatatcatctaggagctaggacctgaaatggggggctcacaactctgttcagtgccctctcctactgtggctgagctggtagccaagaagcaagacaaagccctccttactcttcactctctttcattatgcagaaggaaggagtcacttttgttgctatgagctgcatagcctggggttgggggagggatggtgcaagctctcccttagctgtgccaggtggtgtctctctaggtcatgtgccatgcttgttcactgactctaagcccagcctagcactagctgctgcctacaaattgtagtccttgtgtcctagattgcctttcaagtttacctatgacccccaggcacttcagctcaatgtggcatggcttcccaaggaagtcaagttctgaccgctggaatggatgattcccctctggaatgtggctggtccaaatgcttcctccatgcatgggcactggctgagcccagcacagctttattctctgctgtgaccaggtagcactgagttgaatgtgaagtcctctagttgatgtgctctccctccccagagagcacagattctctctccacactccagggttgctgccaggaggtgggggaagggtggcattggtaattcagtatgtctctcttgcccttttcaatacctctttccacaacatgaagttaaaaccaggtactgtgattactcacctgagttttggttcctgccacggtgctttcctatgtgtagacagttgttaaaatttggtgttccagtgtcggggaggatgggtaaatgaatgatgtaggcttctgttttgccatgtttctcctccccttttttctcaacttttgaaggtatatttgtaaaaataat

SEQ ID NO: 281 - DNA, 16237 bp, Homo sapiens
tctcaacttttgaaggtatatttgtaaaaataatggattaaaccatataaagttgccaatattctactttttttggtctacaaaagggtaatttcgtacagtttgtaagatacaatgaatctttgtgagtctctcttcaaaaggtttagcctgttaacttccttaccctttgttctccaacttaactttcttgtttctccttgccaaaagttactataaacagcttacccccttcccgtcagttctaatcaataactcacatctcttcccttggttacctgtacccatttttcccttgaaactgcacgtctcacaagctccaccactgtacctcacatccccctcccttccatatttagaaaaatatttacaagtagccaattgggtcagctcagattttgcggtccaaccccagcccacgggggaagaacacagaaatagggatgacgttaagggtataaaaaactcccggtcccctttgttcagtgtgcacttgcaatcttgattgacgtgagtggcacccttttgcaaaagtaaattgccttgctgaggaaactaaatttatattcgagtgctgtttcttttgaggcatcggaaattcatttataacaatttggtggctcgtatggggagcccattcttctctggggagggatttccggtcctttcccgtgagaaggcacgccccgccacctcattgcagtggcttcaggttgaggaatcgagacccacccagtgtgatgaataaacccggcctctcagcaacccgggaaaggaacaagccggcagcttgggaaaatggggctcacatactgcagcgaccaggtaaactctgtgcacaaaccaaggtaagaaaagtcacaggggcgacaaagtatttccttggaagttgaaagtgtgtgaatggtaacaattaccactgctgtgcagagtaagtccaatctgcggttccacggtcacctcatatggcttagggtggccctttgggggtcccgtcaggggtttatactggcccaccatccatgataagagggacctgaaatatttctgcaagggaagcatccagagtggacgaagctaaagaagggtacaaggaaccttcagcaggtagggctaaaggataggcaagagattcctcatacaagggaattgagcgttaataagcctccagggaaggataggcaagaaatttctaatatgagaaattgagcctaactaggacccaacatgggaaataccccaagtattatgagaagtgaaaaggataaagatagcaataaatatattcccccagatagtcccctaggtctcatgttaaaatattggaaaggtattgagagaactaaacataagaaaaagcaacaaatgataaaatattgctgttttgtttggacccagggtccactcctcaagccctcaatcttctggccagtttgggtcaaatgaggatgtaatgtatcaactcctaattcaacatgtaaatgataaaagttcagtgttctcaagagaaactggactatgctctttgttagagacagggacctgttctcctctatcccttaaaaacaactagggaaaagcccgatctagcatccgacaatgaagactcaaaaaacctggtttccatggctaaggactccagcgcatgggatcccctagaccaccttcccccactcattgcccccaatccttcccctcaggcagctgctgctgccctggatcctgccccagatccttcttctccttacgttattcctcctccttataatcctgattcttgggaatcatcatgccataaacctgttccctctcagcctaagtgcccctccctgaaggaactccaacatgaagtagaacaatgtaaaagagatatccaaaatttctcatttccctccacatctatggagtcagctctgactctcttccgcttgagagaggtaccacaaggaggaggtgctattggctttgtaagtgctcccctaactagttcacaagtctggaatttaaagaaggaacttaagccattattagatgacccttatgggttagcagatcaagttgatcaatccctgggacctcagttacacacctgggttgagttaatgtccattttaggcattctcttctcgggggaagaaagagggatgatcagtagggctgctatggtaatttgggagcgtgaacaccctcccagtcaagacgttcctaccgcagatcaaaagcttcctggccaagacccctggtgggacaataataacccagctcacttggaaaatatacaagacctaagggagatgataataaagagaattagggaatcagtaccctgaacccacaacctctctaaagcacttgatatacaacaggaaaaagatgaggggcctatgaaatttctaaacagattgaaggaccaaacgagacaatattcaggcctaaacttagaagacccccttggacaaggaatgttaaaactccactttgtcactaagagttggccagatatttcaaagaagatacaaaaattagaaaattgggaagaccgacctctgagtgaacttctcagagaagatcaataagtatatgttagaagagatgaagagaaacaaaaacaaagggcaaaacttggtggaaccaaatccacatacttctaaacaaagcttccagggggccggaaactataccaggtccagacccccgtttaaaagaaccaagcctccatctagaggacccagaccctcatctaccagaccctctaaagagtatgggggaacaacgttgcaaagtcctggagctgggagagaagaaggacaagagaggtgttacagatgtggaagggcaggccacttcaaaagagaatgtcccaaattacaaagggagagacaagccctttccctcattacctctgaggaggagtagggggctcaggggctctgtctcttttacttcaagtcccaccagaagcccttgatacatttagaagtgggacccaatcatgagcttatcacctttctagtcgattcaggggccgctcgctcctctgtttccctctatctgacattgcctgctcttcagaagacctttgagtctctgggataaaagtggaagggtttaaagcaaaagtcttagaaagtacagaagttaaattctaagattgattgactcatatccaatttttattgatccctgaggcaggaactaacttattaggaagagaattaatgttgaagttaggcatagtcttataagttagtctaaaaggattccttgcctcattaaatttactcaccaccacagatgagaaatgtattcactcgttgtgaaggaaaccaaggaaaacttcagattcccacaatccacatcaagctaaaaaccccagaggaagtggtgaggaggaagtaattctctattccttcagaaggacagatagggttaaagcccataattgaaagtgtcatgaaagatgggcttcttgagccttgtatgtctctttataacaccccaatactgcccgtcaagaaatcagatgggtcataccggttagtacaaaatcttagagctatcaaccaaatagtaccaactattcaccctgttgtccctaacccttacactattctcagtaaaattccatatatccatcaatggattactgtaacagactcaaagcatgctttctgggcatgtcccctagctgaagatagctgaggcacattcacttttaagtgggaagacacccagtcagggtaaaaacaacagtatcagcagacagttttgccccaagggtttgcagactcacccaacctctttagtcagattttagaacaagtgctaggaaaggtttctgttccaaagcatacatgcatgctccaatatgttgatgatatcctcatatcaggagaggatgtggaaaaagtaaccagtttttccatacatatccttgatcatctacattctgaggggctacaagtctcaaagaaaaagcttcagtatgcagaacctgaggtcaaatatttaggccatttcgtaagtgcaggcaagtggagaatagtgccggagcaagttgaaggcatcgtgtatttacccttgcctcaaactaagcatgagctcagaaaatttctaggattagttggatactgccgcttatggattgactcatatgccttacacagtaagctgctataccagaagcctactccagaaaaacctgaccatctcctgtggacttctgaggaagtcaaccaaattgaggaattaaaagaaaggcttatgactgccctagttttagcttcgccttctctagaaaagccctttcacctttttgtcagtgtaaataatggagtggctataggagtgcttacccaagagcacagtggctgccggcagcctgtagccttcttatcaaaggttttagacccagtcacttgtggatggcctcaatgcatccactctgttgctgctatggcaatattagttgaagaaagcagaaagttaactttaggggtaaagttgactgcaagcacaccccacgaagttagagcaatactaaatcaaaaagctgggaggtggcttactgactccagaatcctgaaatatgaagttattttgctggaaaaagatgatttaaccttaactactgataattcactcaacccagcaggtttcttaacaggagatccaactctaaacagggagcacctatgtctcaatttaattgactaccaaaggtcagaccagacctaggggataccaccttcaaaacaggatgacacttattcatagatggttcctcctgggtgattgagggaaaaagacacaatgggtattcagtaattgatggggaaactcttgaagaaatagagtcaggcaaattgcctaataattggtctgcccaaacttgtgagttgtttgcactcatccaagctttaaagtaattgcaggaaggaaccatccatattgattctaaatatgcctttggggtggcccatacatttggaaaaatttggactaaacaaggtcttattaatagcaaaagccaagaccttgttcacaaggagttaatcacccaagtattagataatcttcagtttcctgaagaaatagctattgttcatgtttccagacaacagaaaagcctttcttttgaaagctagggaaacaacttagcagatcagatagccaagcaggctgccgtttcatctggaacacctgtctttcacttaaccccttgtcttcctctactgcagtccctgtcttctcagccgtggaaaaagaaaaattaataaaaataggggccaaagaaaactcagaaggaaaatgggtattaccagaccaaagggaaatgctatccaaacctctcctgagagaaatcctgcctcacttgcatcaagggacccactggggacccaaagccatgtgtgacgtagttctcagagttcatgggtgtataggaatttataccttggccaaacaagtcatggacagttgcttaatatgtaaaaaaaacccaacaaacaagttataaagaaatctcccttggtggggaggaatccagggctaagaccattccaaagtattcagagtgactacacggaaatgcccccagttgctcatctaaagtatttgttattaatagtagatcacctcactcactggatcgaagctattcccttttcaaatgcaacggccaataatgtagtaaaagcactaattgaaaatacagtgcctagattgggactaacagagaacactgactcagacaatggaacccatttcacagcacacatcattaaaaagttgtcccaagacctagacattaaatgggaatatcatacaccttggcatccatcttcatcagggagagtagaaaggatgaatcaaactttaaaaaatcacttaaccaaattagttctagagactcagttaccatggaccaaatgtcttcctatttattgccctgttaagaatccaaactgcacctcagaaggatataggcctttctccttatgaaatgccctatggactgccctatttacactccactacctatatccctacgtttgagacaaaagatcaattcctcaggaattacatatttggtctctcctttaccttctcttctcttaaagccaaaggtctcatggtacaggcaccactcctagagttcctggtccattagcatcagcccagggatcatatcctcatcaaaagctggaaagaatgcaaacttgagccagcctgggaaggaccctatctagtgctcctgaccactgaactgcagtccggacagcagagacttgacacttgagtcaagaaagcaccgtccaccccgaagtcatgggccattattccaggggaaaaccccctcaaactaaagctaagaaaaatttaactctcttccattcttcttttcaccttccaatgctgaccaccttgttattaattaactaaatcaaacacaccccaagttattacatttgacgcttgtctagtcataccctgtagagatctccaaagtcagaggcaactctcagcctcagaaaagtatctctgcccctttaaagtgaaaggcgccccctaccaagactcttgttccttaacaaatgtaggaaaacaagtctgtcatagctggaatgatgtcctgtggaaaaccgaatatcaaggctggacctcatcagcgagtggttgtatatccttaaaaccatatattcgttttactaaggagagcacctcccccagttgccagtgtaaccaatgtaatcccatatacatttctattctcattcccacctctactgatcctaaacctactttaagtcgcttctataacataggagccaacttggctgcacagacctcatagggtcttttgaaatgcgttttattaatccttcattctcttcacccccttccttctcttctccttctgagctttcttctaatcagactgccatctcttctatacctaatgataatactaaagtagatattgtagcagtagatggtctaaggcaaactttagaaattgaaacaggatatcaagatgtaaacgcctggttggaatggatcaaatattctgtctcacattaaataaaagcaattgttatgctcgtgcacatggctggccagaggcccagatcatcccctttccactcagatggtctcccagtcaactgggcatgggctgcatggtagctcttttctaagattccatggcttggggcaacaaattgtggcaagctctctctctgctatatcccaaagtgcaacaccctgtgggtcagcccccaagggccattcagcttcggtcttctgctcatttcacctcgtgtctctcatgacagggggagaacttagtgttccttggcagcttagcaggacgcagtgagcttaagcctttgcaggagcttacccatcagtcgccccttagtcatcctcaagcagatgtatggtggtgttatggtggacccttactggacactctgccaggtaactggagcggtacttgtgctcttgtccaattggctatccctttcaccctggcagttcatcaaccagaaaaagaaaaaacacaacgccacaaaataaaagaagccccttatgggtcttttgactctgacgtttatttagatgcaattggagtcccacagggggtacctgatagattcaaagcctgagatcaaatagctgcaggatttgaatcattatttccatgggtaactattaataaaaatgtagattggataaattatatctactataatcagcaatgatttattaattacactagaaatgctgtcaaaggaatagttgagcaattaggacctactagccaaatggcttgggaaaacagaatggccctagacatgacgttagctgaaaaaggtggagtttgtattatgatcaaaacccaatgttgtacctttatcccaaacaatactgcccccgacagaagcataacaaaggccttacagagactgactgctttgtccaatgaactagctaaaaattctggaattgatagccctctttcaggatggctagaaagatgatttggtaaatggaaaggagtcatggccccaatcttcacttctcttgcagtcatgataggtgtgcttattcttgttaggtgttgcatcataccatgcatccgtgggctagtacaaaagcttataaagacaacactcactaaaacctcccttagttctcctccaccctattcagataagcttttccttttagaagaccaagttgaacagcaaagccagaacatgttaaaaaggtctgaagagaaaagattataaaaatttaaaagggaggaattgtaagatacaatgaatctttctgagtttcttttcaaaaggtttagcctgttaacttccttaccctttgttctccaacttaactttcttgtttctccttgccaacagttactgtaaacagcctacccccttcccgtcagttctaatcaataactcacatctgttcccttggttacctgtacccatcgttcccttgaaactgcacgtctcacaagctccaccactgtacctcacgtccccctcctttccatatttagaaaaatatttacaagtagccaatcagatgagctcagattttgcagtctgaccccagcccatgggggaaggacacagagatagggatcgcgttaaggatataaaaaccccctggtgtcctttgttcagtgtgcacttgtgaccttgtttgacacaagtggcacccttttgcaaaagaaaattgccttgatgaggaaactaaatttatattcgagtgctgtttcttttgcggcatcggaaattcatttataataagttcaacttaatatttttgtggtggaaaaacatttatctgaaatgtacaattaattttaatttgattttgattttccttttattaagttggctaaatatatacttaaaatatatattatggagtgcataaacctatttttgtacaatttttatcatgttccttcaatctgttcattctactaaatatatattcttctatgtttacttatgatataaacagtgatgtttaaaatgattctcacttgggaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgcgcactgtgcgcgagccgaagcagggcgaggcattgcctcactcgggaagcacaaggggtcagggagttccctttcctagtcaaagaaaggggtgacagacagcacctggaaaatgggtcactcccacccgaatactgcgcttttccaacgggcttaaaaaacggcgcaccaggagattatatcccgcacatggctcggagggtcctacacccacagaatctcgctgattgctagcacagcagtctgagatcaaactgcaaggtggcagcgaggctgggggaggggtgcccgccattgcccaggcttgcttaggtaaacaaagcagcccagaagctcgaactgggtggagcccaccacagctcaagaaggcctgcctgcctctgtaggctccacctctgggggcagggcacagacaaacaaaaagacagcagtaacctctgcagacttaaatgtccctgtctggcagctttgaagagagcagtggttctcccagcacacagctggagatctgagaacgggcagactgcctcctcaagtgggtccctgacccctgacccccaagcagcctaactgggaggcaccccccagcaggggcagactgacacctcacacggccgggtactccaacagacctgcagctgagggtcctgtctgttacaaggaaaactaacaaacagaaaggacatccacaccaaaaacccatctgtacatcaccatcatcaaacagagcagaaaaattggaaactctaaaaagcagagtgcctctcctcctccaaaggaatgcagttcctcaccagcaacggaacaaagctggatggagaatgactttgacgagctgagagaagaaggcttcagacaatcaaattactccgcgctacgggagaacattcaaaccaaaggcaaagaagttgaaaactttgaaaaaaatttagaagaatgtataactagaataaccaatacagagaagtgcttaaaggagctgatggagctgaaaaccaaggctcgaagagaactatgtgaagaatgcagaagcctcaggagccgatgcaatcaactggaagaaagggtatcagtgatggaagatgaaatgaataaaatgaagtgagaagggaagtttagagaaaaaagaataaaaagaaacgagcaaagcctccaagaaatatgggactatgtgaaaagaccaaatctacgtctgactggtgtacctgaaagtgacggggagaacggaaccaagttggaaaacaccctgcaggatattatccaggagaacttccccaacctagcaaggcaggccaacattcagattcaggaaatatagagaacgccacaaagatattcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggtagaaactctacaagccagaagagagtgggggccaatattcaacattcttaaagaaaagaattttcaacccagaatttcatatccagccaaactaagcttcataagtgaaggagaaataaaacactttacagaaaagcaaatgttgagaaattttatcaccaccaggcctgccctaaaagagctcctgaaggaagcgctaaacatggaaaggaacaaccggtaccagctgctgcaaaatcatgctaaaatgtaaagaccatcgagactaggaagaaactgcatcaactaacgagcaaaataaccagccaacatcataatgacaggaacaaattcacacataacaatattaactttaaatgtaaatggactaaatgctccaattaaaagacacacacagactggcaaattggatcaagagtcaaaacccatcagtgtgctgtattcaggaagcccatctcacgtgcagagacacacataggctcaaaataaaaggatagaggaagatctaccaagcaaatggaaaacaaaaaaaggcagggattgcaatcctagtctctgataaaacagactttaaaccaacaaagatcaaaagagacaaagaaggccattacataatggtaaagggatcaattcaacaagaagagctaactatcctaaatatatatgcacccaatacaggagcaagcagattcataaagcaagtcctgagtgacctacaaagagacttagactcccacacattaataatgggagactttaacaccccactgtcaacaatagacagatcaacgagacagaaagtcaacaaggatacccaggaattgaactcagctctgcaccaagcagacctaatagacatctacagaactctctaccccaaatcaacagaatatacatttttttcagcaccacaccacatctattccgaaattgaccacatacttggaagtaaagctctcctcagcaaatgtaaaagaacagaaattataacaaactatctctcagaccacagtgcaatgaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacatccaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaaatgaaggaaatagagacacaaaaaacccttcaaaaaattaatgaatccaggagctggttttttggaaggatcaacaaaattgataaaccactagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctacaagaaatggataaattcctcgacacatacactctcccaagactaaaccaggaagaagttgaatctctgaatagaccaataacaggatctgaaattgtggcaataatcaatagcttatcaaccaaaaagagtccaggaccagatggattcacagccgaattctaccagaggtacaaggaggaactggtaccattccttctgaaactactccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaacagaatccagcagcacatcaaaaagcttatccaccatgatcaagtgggcttcatccctgggatgcaaggctggttcaatatgtgcaaatcaataaatgtaatccagcatataaacagaaccaaagacaaaaaccacatgattatctcaatagatgcagaaaaagcctttgacaaaatccaacaacccttcatgctaaaaactctcaataaattaggcattgatgggacatatttcaaaataataagagctatctatgacaaacccacagccaatatcatactgaatgggcaaaaactggaagcattccctttgaaaactggcacaagacagggattctgtcaccactcctgttcaacatagtgttggaagtcctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaatgtctcaggatacaaaatcaatgtacaaaaatcacaagcattcttctacaccaataacagacaaacagagagccaaatcatgagtgaactcccattcacaattgcttcaaagagaataaaatacctaggaatcaaacttacaagggatgtgaaggacctcttcaaggagaactacaaaccactgctcaatgaaataaaagaggatacaaacaaatggaagaactttccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccagaaaagagcccgcatcgccaagtcaatcctaagccaaaagaacaaagctggaggcatcatactacctgacttcaaactgtactacaaggctacagtaaccaaaacagcatggtactggtaccaaaacagagatatatatcaatggaacagaacagagccctcagaaataacgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaactttagaccaaaaaccataaaaaccctagaagaaaacctaggcattaccattgaggacacaggcatgggcaaggacttcatgtctaaaacaccaaaagcaatggcaacaacagccaaaattgacaaacgggatctaattaaagtaaacagcttctgcacagcaaaaaaaaaaaaactaccatcagagtgaacaggtaacctataaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactgtaaactagttcaaccattgtggaagtcagtgtggcgattcctcagtgatctagaactagaaataccatttgacccagccatcccattactgggtatatacccaaaggactataaatcatgctgctataaagacacatgcacatgtatgtttattgcagcattattcacaatagcaaagacttggaaccaacccaaatgtccaacaatgatagactggattaagaaaatgtggcacatacacaccatggaatactatgcagccataaaaaatgatgagttcatgtcctttgtagggacatggatgaaattggaaatcatcattctcagtaaactattgcaagaacaaaaaaccaaacaccacatattctcactcataggtgggaactgaacaatgagaacacatggacacaggaaggggaacatcacactctgcggactgttgtggggtgggggtagggggagcgatagcattgggcaatatacctaatgctagatgatgagttagtgggtgcagcgcgccagcatggcacatgtatgcagaggtaccagcatggcacattgtgcacaggtaccctaaaacttaaagtataataataataaataaataaataagtaaaaaatgattctcactaaatgttaataatggttattttaagagtagttagaatttgtggtgggtttttatttctttttttgtaattttgtattgctttaatttttcaaaacaaagatgtataatttatagaacaatagcaaagtcgttactccaagatcaataaaggaagagaccactaacaggaaaaacaacggaaaagcaagtgtggaatatatgggaccaaagaattttctagcctgtctcctgtatctgcagctggcttctttcaaactgtgtgagtgcctttataatgcaaataaaaggattaattcccctgatgttttgctactgagccagacctttacatgttcaagaatatggtcactatattgctgactatgtccacttaagttggaaataaaatgcgcaagtataatttttcaagatgtggtttgccaactagcagcactggcatcacctgggtatttgttagatatgcagaatcttaccttacctgacatactcaatcagaattttcatggtgacaagatcccctgaatgatctgtataaacatttaagcttgaaaagcactgctttaaaagatctaatggctcaattttccaataaggatattgaacagcggcttacataaagctacagagattaatcctatagtgggtttgcagaaaggagaaaaaaagattttttccgtgcacatgaaattattcattccacaatttagctgtgttttataggctatggggtccatctttggtgtggctgggcatccacacatttttaaacatattcagagtgatatcggggatttccaggaaaacagacacaacggttgatggttaaagaagaaaaaggaaagctttcttgtttgctggcttgttttgttagcgcaagatatgaagaatccggctgagggcagagttaattagcattatctaaagtgaaaaaaaaaataggattacctgcaagagatctcagcacttgtaattctttttccaaattgtctaaagtatgttgatcagtagtgtcatctaaggaaagctcattctggtcagtaatatcaatatattcaatttctgaaatttcagaagcagctctagatgatgattgagcagctgcacttcttgatcgaggatgagaggatgaaaggcaactggagc

SEQ ID NO: 282 - DNA, 5359 bp, Homo sapiens
tctcctttcttcagaacatatgactttcatttcccagaaaaaagattaatggtcctgagtaggaatattacataattttgattgcatcattagttaattattttcttcatattgtagattttctgcagtcacccatacttaacatttgtaatacattttcctgatttgaaagtttgtttttaaaagttttctattaattatagtgcactattgaatcaggaaaatttaagaaaaagaatagttagttttaaatgcataatatcaaagagaatcatagatgatcattaaatttttagaaattctcggaagttaaggagaagcactgttttttataaaaatttacaactgatttttatttttaaaatatctagataatttttgcatggttgcattctgaaaatattataaactagtgctggtaactctaataaaggtagtattactatatatcactggtgggatagaatctagaggcaaaaaaacctcacagcagtaaaatcttaaaatgctttcatggtcttagggtaaaattatctaatttctccaacaaataaatagcatgaaaaacaggaggagagaagtctacagtaggaaagatcttacgagatctaccaatcaaacgtaatgtgtggatcttgtctggatcttcattcaaacatcagcaatgactttgaaacacttggaagagtttgaatatagatgggtattaagtaatattaactgaattttttaggtataataatggcattgtacttaagggtatttttagagtcacttaaagttattatgcatttaaagaaatgtacaatgaagtatttgtgggtgaaaattcagtttgtctggaacgtaaagatgttggagggatagcgtcaagaattatggcaagacattgataatagttgatgctagtactgagtaattgcaggttaattttactcctctccttttatgagatatgaaaaatatcaaaataaaagctttttaaaattgatgctattagaagagaaatagaggtaacaaaaaaggacacgcttccccagaaataaaatcaccactgctgttacacattttgtctctatttagacaagctctccagcctttccctgtttaccttcactgtttgacataacttctctacctgagatagtcatgttcctgtactattctaccatgtaattttgaggtgtttttctagttatagcaatggatttatgcagagtcacctacctggtggtatcaaattgccatataccgggtacatagtttatttttaagcttaatctctctttgaatcagtttcctcatgtgtaaggtggggaaatcacaacagccctatgtggtaggtgctattattatcctcattttacagatgaggaaattaaagcagagagattaaataatttgttcgaggttcacagctactaattattcctatggttcatggaaataaaactataaagatctaaatgttgcccatgttaactactattatatttgaaattctttttgccaagctagactgttacctaaatatttcctttttgcccaaaactcagttagcattgttgaaagactaacgcaatttctccttcgggcagttgtctgctcagtaacgtccggcgatattaaccgtggtgttgtaactttacatagtcccagggtacatacaggcagagttgggaatattacatctattatcatcccacaaaatgtaagatcctgtgaggacccgtggtggcgctgcaggataagaaggcacaaaccagaaccgcagctgcagctccattaaccggcaaaaagcagcagaacctggaagtccacggggagcttggatgccaaagggaggacggctgggtcctctggagaggactactcactggcatatttctgaggtatctgtagaaaaccacagcctcagatactggggactttacagtcccacagaaccgtcctcccaggaagctgaattcagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactgcgtttcctctgaagaatgctgaagacttagatataggccaaaacaatattgagaactatataatcagccccaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacattgaagttgtcgatgtcaatgataatgcccctgaatttgagcagcctttctatagggtgcagatctctgaggacagtccaataagcttcctggttgtgaaggtctctgccacggatgtagacacaggagtcaacggagagatttcctattcacttttccaagcttcagatgagataagcaaaacttttaaggtcgatttcttgacaggagaaattcgactaaagaaacaacttgatttcgaaaaatttcagtcctatgaagtcaatatcgaggcgagagatgctggaggcttttctggaaaatgcaccgttctgattcaagtgatagatgtgaacgaccatgccccagaagttaccatgtctgcatttaccagcccaatacctgagaatgcgcctgaaactgtggttgcacttttcagtgtttcagaccttgattcaggagaaaatgggaaaataagttgctccattcaggaggatctacccttcctcctgaaatcttctgtggggaacttttacaccctactaacagagacaccactagacagagaaagcagagccgagtacaacgtcactatcaccgtcactgacttagggacacccaggctgacaacacatctcaatatgaccgtgctggtgtcggacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggatccgcacctgcccctcgcctccctggtctccatcaacacagacaacggccacctgttcgccctcaggtcgctggactacgaggccctgcaggcgttcgagttccgggtgggcgcttcagaccgcggctccccggctttgagcagcgaggcgctggtgcgcgtgctggtgctggacgccaacgacaactcgcccttcgtgctgtacccgctgcagaatggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggcgaggtgcgcaccgccaggctgctgagcgagcgcgacgcggccaagcagaggctggtggtgctggtcaaggacaatggcgagcctccgtgctcggccaccgccacgctgcacttgctcctggtggacggcttctcccagccctacctgccgcttccggaggctgccccagcccagggccaggccgactctctcaccgtctacctggtggtggcgttggcctcggtgtcttcgctcttcctcttctcggtgctcctgttcgtggcggtgctgctgtgtaggaggagcagggcggcctcggtgggtcgctgctcagtgcctgagggcccctttccagggcatctggtggacgtgaggggcaccgggagcctgtctcagaactatcagtacgaggtgtgcctggcaggaggctcagggacgaatgagttccagttcctgaaaccagtattacctaatattcagggccattcttttgggccagaaatggaacaaaactctaactttaggaatggctttggtttcagccttcagttaaagtaattgatttcatattatatattttaatttttatgatcaattcaaaggaatggttttctgtcaacttagcataaattttaaattacactacatttgcccatagtatttgtcttgttttcactgttttaaaaaatgatatctcatcttctcttcattagtatatccagtggactctaatcataattctttaacagtgcaatttttgttaaaatgtacatagtaaaatgcacagatctgaagtgaagaaattaatgtaactgatctttttaagcctttattttttgatttctaatctaggtaaaatttagttaaaagtggtgtagagaatgttttacatttattgccttttaaatgtttccccaagtcctaagggagttgacatattatccccttttttaaatatgagaaaactgaggcttagaaaggtaacttggctgtgagctgtggctcacacctgtaatcataacactttgagaggctgaggcaagctgaaccctttgagctcagtagttcaagaccagcctgggcaatggggcaaaacactgacactaacaaaaatacaaaaattagccaggtgtgattgcgaacctgtagtcccagctactcaggaggctgaggtaagaggatcccctgagcccaggagacagagactacagtgagccaagattgtgccattgcactccaggctgggtgacagagtgagacctcattcccccccacaaaaaacgattaactttcttataattctgaaataataaaggtaaaaatttaaaatataatctaagtctagccaatatgctatatggtcaggcattaactgatagcattgtttttctaactaaggaagtgaaatttatgttattcctactcctactccatgaactaaactctcatgtgaaaatataagttttagtttatagtttgtttatactactctgcacaaatatacccatgttcttatcaaagctctaagtat

SEQ ID NO: 283 - DNA, 105 bp, Homo sapiens
aaatccctctgagtccagaaataagggtatgcatgatattatacctggttttcagggcatttaccaccttttttaaaatagaaaattgagagtacaaaaacacta

SEQ ID NO: 284 - DNA, 22181 bp, Homo sapiens
agcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggccc

SEQ ID NO: 285 - DNA, 9331 bp, Homo sapiens
agcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagat

SEQ ID NO: 286 - DNA, 31412 bp, Homo sapiens
ccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggccc

SEQ ID NO: 287 - DNA, 18562 bp, Homo sapiens
ccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagat

SEQ ID NO: 288 - DNA, 23766 bp, Homo sapiens
ccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttat

SEQ ID NO: 289 - DNA, 13616 bp, Homo sapiens
ccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacata

SEQ ID NO: 290 - DNA, 4947 bp, Homo sapiens
aatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagat

SEQ ID NO: 291 - DNA, 21009 bp, Homo sapiens
ggaactttcctctgaactgtgatcatggttataattaacaacacattcaatctgtggcatctgcatgctgcgattctcacccgaactccacgaagcaggaatacaatgagtatcatccccatttgtcagatggggaactaagttctgctggaaagtgacagagccaacacttttgactttctggtggggacaggagccagcaaagcctagttctgagtcaaggggttacataattgtttaaagatgatgccttctgtttgtagagagcttggctatttacatgaaaagcatgtgatttcctggcatgcttttcatttgctctcctaacgccaagaggaaggcagggatgatggagggtccccattttgcagaggaggaaactgaggcccaaagagattatgggccttgcccaggtcataaaacacggagatggggctggacgaagtggctcatactagtaatcccagcactttgggagactgaggcaggaggagggcttgagcacaagagttccagactggccccagaaacatagggagaccctgtctctaaaaaaaattttaaagcagtggggcatgatggtgtgcacctgtaggcccagcagaagcaggagggatcacttgaacccagggatttgagactgcattgagctatgattgcagcgctgcactccagccagggtgacagagcaagaccctggctcaaaagagagaaaaaaaaaaagtccgggtgtggtagctcaagtctgtaatccctgcactttgggaggccaaggtgggtggatcacttgaggtcaggaatttgagaccagcctggccaacatggtgaaaccccatctctactaaaattacaaacattagccaggtgtggtggtgcatgcctgtaatcccagctacttgggaggcagaggcacgaggattgcttgaacctgggaggcagaggttgcagtgagctgagagatcgagtcactgcactccatcttgagcaacaagagcgagactccgtctcaaaaagaaaaaaaaaagagagagagagagagtcccttttctctctgacccaggatcaccagggagaggaaagagaagagatggagtgaatgagacagctgtggtcagcaaggcgtgtccatcttccacgaccgactccttcccattcaatcccctgccttgggatcctgcttcttccctgcataggcagaaagtacctaccaacttcccttcttcccaactccctgctctgagtactgcgctaggagccaactcagccacctcctgcagccccagctctccatcttaactgcagcctctcgctcttgggtactcactgactcaaatcctccctctgggcccaagcatcaggctgaacaaagacctgtccctagttcacaggtcacctaggattctttttttttttctttgagatggggtttcgctcttgttgcccaggctggagtgcaatggcgcgatctcagctcactgcaaactttgcctcccgggttcaaatgattctcctgcctcagcctcctgagtagctgggattacaggcatgtgccaccacacctggttaattttgtatttttagtacagacagggtttctccgtgttggtcaggctggtctcgaaccccgacctcaggtgatccacctgcctcaacctcccaaagtgctgggattacaggcgtgagccactgtgcctggccagtcacctagggttctgctggaactactgaactgtagttcagtaggtgatcttaccacagtagggtttgttgctggagttgcattagctaaacagggtcttttagacactggaatctaagctgaaggctaataatattatttgaagatggtgaaagttaattctactaaaattccatcataaaactgtggcattgtgaaggattgttggcaacaaataaatagacgatagtatagtttctcaatttatgggagtcatggccaaatgtctctaaactcccttctttatttaagaaaattgattattaaaaatggccagtggttcacgcctgtaatcccaacactttggggggccaaggtgggcggatcacctgaggtcaggagttcgagaccagcctgaccaacatggtgaaatcccgtctctactaaaaataaaaaattagctgggtgtggtggtgcatgcctgtaatcccagctagttggaaggttgaggcaggagaattgcttgaacctgggaggcggaggttgcagtgagccaagatcgtaccattgcactccagcctgggcaacaagggcaaaacaagataaaaaaaaaattacgtgaccgggcgcggtgatgtacacttgtaataccagcactgtgggaggccaaggtgagaggatcacttgaggctggtagtttgagaccagcctagtcaacatagtgagatccctgtttctataaaaaatttgctgggctactaaaaaatagactgtagttccaactacttgggaggctgaggttgtagtgagctatgattgagccactgaactctaacctgggtgatagagcaagacactgtctcaaaaaaaaaagtgactgccacacataaatttctttcttttattattattattattattattttttgagacagagtctcactctgtcacccaggctggagtgcagtggtgcgatctcggctcactgcaacctacccctcctgggttcaagagattctcctgcctcagcctcctgagtagctgggactacaggtgcgcaccaccatgcccagctaattttgtatttttagtacatacggggtttcaccatgttggccaggctgatcttgaactcctggcctcaggtgatctgcccaccttggcctcccaaagtgttgggattataggtgtgagccactgcacccagccaacatcatagatttctggctttaaaaaaatcttggctgtactgattgagcctcctccccaatcttacagaggaaggaactaagacacagagagggtgagaaaagttcccaaagacacacagcaaatttaggactgggctccagttctctcaagggcttttccacagcccaaggtctctcacacctgttcccacagctgccagtcttgtcaaggttgccagtctctggggcgttgctggttcctggctccctaaaatacagggcccaagggtcctcccccactttcctgtcctgccgtgagccccccacccccacttccagacggattgggagctgtgacccccagctctgtggtcccaaagggaggtcagctaaagcagctaccaggggacttattgcccaacagggagtggctatgatcaatgtcttctgctcctcttccctgggttaaccatttcctggccctggcccctctgttaattcctctgctaacctggtatggaggaagggtggacaagggcttgggatggacaccattgatatccccaggtctgacataaacaggcaggggggtgctctcagtcctcagatgtgatccctgcctgagctctgttggcattccatggcgaggctcttcagcctcatttgggcagaagcggtcctggggattgcaaaagggctttctttttcttttatttatttctttttagaaacagagtctccttgtgttgcccaggctggagtgcaatggtacaatcatagctcactgcagccttgaactcctgggctcaggcgaccctcccgcctcagccttctttgtaactggaactacaggtgtgcaccaccatgcttagataatttttgtattttttgtgtagagggtgggttctcgctatgttgcccaagctggtctcgaactcctgggctcaagcaatcctcctaccttggcctcccaaagttctgggattacaggcacaagccaccgcgcccggccatttcttttcttttcttttcttttcttttcttttcttttcttttcttttctttttgagacagatttttgctcttgttgcccaggctggagtgcaatggcgcgatcttggctcactgcaacctctgcctcccaggttcaagcaattctcctgcctcagcctcccgagtagctgggagtacaggcatgcaccaccatgcccaactaattttttgtatttagtagagatggagtttcaccatgttagttaggctagtcttgaactcctgacctcaagtgatctgtcaacctcggcttcccaaagtgctgggattacaggcatgagccaccgtgcccggcctccggccatttcttaatatgatccaattacatacctactgataaatatttatcataacttttcctattgtaaacaatgttgcaattaatatctttgggtatccgcaaatttgtgcaaagtgcatgtatttctgtagcaagtttcctagaaatgttaggtcaaagatatgcacatttgaaagttcaacagtcattgtcaaatgccttctaagaagttttctggccaggcactgtggctcacacctgtaatcccaacactatgggaggccaaggtgggtggatcacctgaggtcagaagttcgagaccagcctgaccaacatgatggaaccccatctccactaaaaatacaaaattagccgggtgtgatggcacatgcctgttaatcccagctacttgggaggctgaggcaagagaattgcttgaactcgggaggtggaggtttgcagtgagctgagattgtgccattgctctctaggctgggttgactcctcccccaaaacaaacaaacaaaccaaaaaacaaatgccttctaagaagttttcaccggctgggcacagtggctcatgtttgtaatctcagcactttgggaggctgaggcaagcggatcactggagcccaggagtttgagaccagcctgggcaacatagtgagaccctatctctacaatacaagcaagcaaaaaaaacaaacagaaattagctaggcatggtggcttgtgcctgtaatcccagacaccccgggaggctgaggtgggagaactgcttgagcctgggaggttgagactgcagtaagctgtgacggcaccactgcactccagcctgggcaacagagtgagacgctgtctcaaaaaaaaaaaaaaagttttcaccaacattctttttttgttttgttttgagacagggtctcgctctgttgctctggctggagtacagtggcttgatcatagctcactgcagccttgaacgcgtaagtcctcccgcctcaacctcacaaccagctgggacctacaggcacatactgccatgcttggttaatttttaaattttttgtagagacagggtctcactgttttgcccaggctggtctctagcctcaagcggtcctaccatctcggcctccaaaaagcacttgggattaccagcatgagccactgcacctggccaccaacctacagtcttatcatcactgagttcgtatctacctgcatcctgtccaatactccgtactaccaatctttcaaatttttgtcggctgggcacagtggctcatgcctgtaattccagcactttggaaggccaaggcaggcagactgcttgagcccaggagtttaagaccagcccgggagacatggcaaaaccccatttctgcaaaatatacaaaaattagctgggcttggtggcatgcactggtagtcccagctactccagaggctaagatgggaagatcacctgaccccgggggtttgaggctgtaatgagccaagtcatgctgctgcgctccagcctgggtgacagaacgaggccctgtctcaaaaaaaagaaaaaaaaatttttttttggtcaatataagagtcatagttttgattagcatttcccttattactagtgaagcagaacagcttttcaaatgtttgctgcctgtttgtatctcttcctctgtgacttatctttctccgtgatttgccagtaggcatttgcagtcctttttttcttttttttttgacttggagtctcgcgatctcggctcactacaacctccgcctaccaagttcaagtgattcttgcgcctcagcctcctgagtagctgggattatgagcatgtgccaccacccctagctaattttttgtatttttagtagagatggggttttgccatgttggccaggctggtctcgaactcctgacctcaagtgatccacccgccttggcctcccaaatgctgggattacaggtgtgagccaccacgtccagccgtttgcagtccttccttcacctaactctccagttgccactgttgccagttatagaattttaggtttgaaatggttttctgttggaattctgcagacaatgttccactggctcttagactccatggttgctattgaaaagctggatgccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcagggtctagggaggtctggaatatgtgcgagactattccatgaagtggaaatcatggctgggagggcactttgggaggccgaggcaggcggatcacgaggtcaggagatcgagaccatcctggctaacatggtgaaaccccgtccatactaaaaatacaaaaattagctgcctgtagtcccagctacacgggaggctgaggcaggagaatcgcttgaacccgggaggcggaggttgcagtgagccgagatcgcgccactgcactccggcctggtgacagagcaagactccctctcaaataaaaaagaaagttgtgctggcctggcacagtggcttatgcttgtaatcctagcacgttgggagggtgaggctggtggatcacctgaggtcaggagttcgagaccagcctggccaacatagagaaaccttgtctctactaaaaatacaaaaattagccaggtgtggtggcacacgcctgtaatctcagctactcaagaggctgaggcaggagaatcgcttgaacctgggagacagaagttgcagtgagccaagatagtgccactgcactccagcctgggcaacagagcaatactccatctcaaaaaaaaataatgaataaataaaataaaaaagaagattgtgctttcatttggtggtaatcgtccccagctatgccctctgctcctcatcctcctaggtatagttcaaagtcgtttcccagtccccttaagctcacttctccttccaattcctttcactgcagggagtatccggaaacacactctcttctcaggacaacctgggcccaactggcaggctgtttctgtcaattacacagccgtgggacggatacaggtacagagaagcaaggggtcaggtccttgcacatggtaggcacacccaatgttgaaataaattgaggggcctggtgctgtggctcatgcctgtattcccaatactttgggaggctgaggagggaggatcgcttcaggacaggagttcaagaccagcctgggcaacatagaaagaccccatctctacaaaaaaatacaaaaattaggcgggcacagtgatgtgtgcctgtagtcccagctactagggagcctgaggtgggaggatcacttgagccctggaggtcaaggctgcagtgagctatgatcacaccactgtactccagcctgggcaatagagcaagactctgaaaaaaaaaaaaaaagaaagaaagaactgaattgagggtctgggcacagggagtagggattctgggtcctggaatggagtcgagttagatcaggggcttgggggtgtgggctgtgtgctcactcctgctccatctccctttctctccagtttgccgtggtaggcgtttttggaaagaccccagagccagctgtggcagttgatgcaaccagcattgctccttgtgggggtgagagcaggccctgagaggcccggatctctcagaatccggggtgggctgggggagggctggagagcgtcactcaacttgctca

SEQ ID NO: 292 - DNA, 19500 bp, Homo sapiens
ggaactttcctctgaactgtgatcatggttataattaacaacacattcaatctgtggcatctgcatgctgcgattctcacccgaactccacgaagcaggaatacaatgagtatcatccccatttgtcagatggggaactaagttctgctggaaagtgacagagccaacacttttgactttctggtggggacaggagccagcaaagcctagttctgagtcaaggggttacataattgtttaaagatgatgccttctgtttgtagagagcttggctatttacatgaaaagcatgtgatttcctggcatgcttttcatttgctctcctaacgccaagaggaaggcagggatgatggagggtccccattttgcagaggaggaaactgaggcccaaagagattatgggccttgcccaggtcataaaacacggagatggggctggacgaagtggctcatactagtaatcccagcactttgggagactgaggcaggaggagggcttgagcacaagagttccagactggccccagaaacatagggagaccctgtctctaaaaaaaattttaaagcagtggggcatgatggtgtgcacctgtaggcccagcagaagcaggagggatcacttgaacccagggatttgagactgcattgagctatgattgcagcgctgcactccagccagggtgacagagcaagaccctggctcaaaagagagaaaaaaaaaaagtccgggtgtggtagctcaagtctgtaatccctgcactttgggaggccaaggtgggtggatcacttgaggtcaggaatttgagaccagcctggccaacatggtgaaaccccatctctactaaaattacaaacattagccaggtgtggtggtgcatgcctgtaatcccagctacttgggaggcagaggcacgaggattgcttgaacctgggaggcagaggttgcagtgagctgagagatcgagtcactgcactccatcttgagcaacaagagcgagactccgtctcaaaaagaaaaaaaaaagagagagagagagagtcccttttctctctgacccaggatcaccagggagaggaaagagaagagatggagtgaatgagacagctgtggtcagcaaggcgtgtccatcttccacgaccgactccttcccattcaatcccctgccttgggatcctgcttcttccctgcataggcagaaagtacctaccaacttcccttcttcccaactccctgctctgagtactgcgctaggagccaactcagccacctcctgcagccccagctctccatcttaactgcagcctctcgctcttgggtactcactgactcaaatcctccctctgggcccaagcatcaggctgaacaaagacctgtccctagttcacaggtcacctaggattctttttttttttctttgagatggggtttcgctcttgttgcccaggctggagtgcaatggcgcgatctcagctcactgcaaactttgcctcccgggttcaaatgattctcctgcctcagcctcctgagtagctgggattacaggcatgtgccaccacacctggttaattttgtatttttagtacagacagggtttctccgtgttggtcaggctggtctcgaaccccgacctcaggtgatccacctgcctcaacctcccaaagtgctgggattacaggcgtgagccactgtgcctggccagtcacctagggttctgctggaactactgaactgtagttcagtaggtgatcttaccacagtagggtttgttgctggagttgcattagctaaacagggtcttttagacactggaatctaagctgaaggctaataatattatttgaagatggtgaaagttaattctactaaaattccatcataaaactgtggcattgtgaaggattgttggcaacaaataaatagacgatagtatagtttctcaatttatgggagtcatggccaaatgtctctaaactcccttctttatttaagaaaattgattattaaaaatggccagtggttcacgcctgtaatcccaacactttggggggccaaggtgggcggatcacctgaggtcaggagttcgagaccagcctgaccaacatggtgaaatcccgtctctactaaaaataaaaaattagctgggtgtggtggtgcatgcctgtaatcccagctagttggaaggttgaggcaggagaattgcttgaacctgggaggcggaggttgcagtgagccaagatcgtaccattgcactccagcctgggcaacaagggcaaaacaagataaaaaaaaaattacgtgaccgggcgcggtgatgtacacttgtaataccagcactgtgggaggccaaggtgagaggatcacttgaggctggtagtttgagaccagcctagtcaacatagtgagatccctgtttctataaaaaatttgctgggctactaaaaaatagactgtagttccaactacttgggaggctgaggttgtagtgagctatgattgagccactgaactctaacctgggtgatagagcaagacactgtctcaaaaaaaaaagtgactgccacacataaatttctttcttttattattattattattattattttttgagacagagtctcactctgtcacccaggctggagtgcagtggtgcgatctcggctcactgcaacctacccctcctgggttcaagagattctcctgcctcagcctcctgagtagctgggactacaggtgcgcaccaccatgcccagctaattttgtatttttagtacatacggggtttcaccatgttggccaggctgatcttgaactcctggcctcaggtgatctgcccaccttggcctcccaaagtgttgggattataggtgtgagccactgcacccagccaacatcatagatttctggctttaaaaaaatcttggctgtactgattgagcctcctccccaatcttacagaggaaggaactaagacacagagagggtgagaaaagttcccaaagacacacagcaaatttaggactgggctccagttctctcaagggcttttccacagcccaaggtctctcacacctgttcccacagctgccagtcttgtcaaggttgccagtctctggggcgttgctggttcctggctccctaaaatacagggcccaagggtcctcccccactttcctgtcctgccgtgagccccccacccccacttccagacggattgggagctgtgacccccagctctgtggtcccaaagggaggtcagctaaagcagctaccaggggacttattgcccaacagggagtggctatgatcaatgtcttctgctcctcttccctgggttaaccatttcctggccctggcccctctgttaattcctctgctaacctggtatggaggaagggtggacaagggcttgggatggacaccattgatatccccaggtctgacataaacaggcaggggggtgctctcagtcctcagatgtgatccctgcctgagctctgttggcattccatggcgaggctcttcagcctcatttgggcagaagcggtcctggggattgcaaaagggctttctttttcttttatttatttctttttagaaacagagtctccttgtgttgcccaggctggagtgcaatggtacaatcatagctcactgcagccttgaactcctgggctcaggcgaccctcccgcctcagccttctttgtaactggaactacaggtgtgcaccaccatgcttagataatttttgtattttttgtgtagagggtgggttctcgctatgttgcccaagctggtctcgaactcctgggctcaagcaatcctcctaccttggcctcccaaagttctgggattacaggcacaagccaccgcgcccggccatttcttttcttttcttttcttttcttttcttttcttttcttttcttttctttttgagacagatttttgctcttgttgcccaggctggagtgcaatggcgcgatcttggctcactgcaacctctgcctcccaggttcaagcaattctcctgcctcagcctcccgagtagctgggagtacaggcatgcaccaccatgcccaactaattttttgtatttagtagagatggagtttcaccatgttagttaggctagtcttgaactcctgacctcaagtgatctgtcaacctcggcttcccaaagtgctgggattacaggcatgagccaccgtgcccggcctccggccatttcttaatatgatccaattacatacctactgataaatatttatcataacttttcctattgtaaacaatgttgcaattaatatctttgggtatccgcaaatttgtgcaaagtgcatgtatttctgtagcaagtttcctagaaatgttaggtcaaagatatgcacatttgaaagttcaacagtcattgtcaaatgccttctaagaagttttctggccaggcactgtggctcacacctgtaatcccaacactatgggaggccaaggtgggtggatcacctgaggtcagaagttcgagaccagcctgaccaacatgatggaaccccatctccactaaaaatacaaaattagccgggtgtgatggcacatgcctgttaatcccagctacttgggaggctgaggcaagagaattgcttgaactcgggaggtggaggtttgcagtgagctgagattgtgccattgctctctaggctgggttgactcctcccccaaaacaaacaaacaaaccaaaaaacaaatgccttctaagaagttttcaccggctgggcacagtggctcatgtttgtaatctcagcactttgggaggctgaggcaagcggatcactggagcccaggagtttgagaccagcctgggcaacatagtgagaccctatctctacaatacaagcaagcaaaaaaaacaaacagaaattagctaggcatggtggcttgtgcctgtaatcccagacaccccgggaggctgaggtgggagaactgcttgagcctgggaggttgagactgcagtaagctgtgacggcaccactgcactccagcctgggcaacagagtgagacgctgtctcaaaaaaaaaaaaaaagttttcaccaacattctttttttgttttgttttgagacagggtctcgctctgttgctctggctggagtacagtggcttgatcatagctcactgcagccttgaacgcgtaagtcctcccgcctcaacctcacaaccagctgggacctacaggcacatactgccatgcttggttaatttttaaattttttgtagagacagggtctcactgttttgcccaggctggtctctagcctcaagcggtcctaccatctcggcctccaaaaagcacttgggattaccagcatgagccactgcacctggccaccaacctacagtcttatcatcactgagttcgtatctacctgcatcctgtccaatactccgtactaccaatctttcaaatttttgtcggctgggcacagtggctcatgcctgtaattccagcactttggaaggccaaggcaggcagactgcttgagcccaggagtttaagaccagcccgggagacatggcaaaaccccatttctgcaaaatatacaaaaattagctgggcttggtggcatgcactggtagtcccagctactccagaggctaagatgggaagatcacctgaccccgggggtttgaggctgtaatgagccaagtcatgctgctgcgctccagcctgggtgacagaacgaggccctgtctcaaaaaaaagaaaaaaaaatttttttttggtcaatataagagtcatagttttgattagcatttcccttattactagtgaagcagaacagcttttcaaatgtttgctgcctgtttgtatctcttcctctgtgacttatctttctccgtgatttgccagtaggcatttgcagtcctttttttcttttttttttgacttggagtctcgcgatctcggctcactacaacctccgcctaccaagttcaagtgattcttgcgcctcagcctcctgagtagctgggattatgagcatgtgccaccacccctagctaattttttgtatttttagtagagatggggttttgccatgttggccaggctggtctcgaactcctgacctcaagtgatccacccgccttggcctcccaaatgctgggattacaggtgtgagccaccacgtccagccgtttgcagtccttccttcacctaactctccagttgccactgttgccagttatagaattttaggtttgaaatggttttctgttggaattctgcagacaatgttccactggctcttagactccatggttgctattgaaaagctggatgccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcaggg

SEQ ID NO: 293 - DNA, 16094 bp, Homo sapiens
cttgggatggacaccattgatatccccaggtctgacataaacaggcaggggggtgctctcagtcctcagatgtgatccctgcctgagctctgttggcattccatggcgaggctcttcagcctcatttgggcagaagcggtcctggggattgcaaaagggctttctttttcttttatttatttctttttagaaacagagtctccttgtgttgcccaggctggagtgcaatggtacaatcatagctcactgcagccttgaactcctgggctcaggcgaccctcccgcctcagccttctttgtaactggaactacaggtgtgcaccaccatgcttagataatttttgtattttttgtgtagagggtgggttctcgctatgttgcccaagctggtctcgaactcctgggctcaagcaatcctcctaccttggcctcccaaagttctgggattacaggcacaagccaccgcgcccggccatttcttttcttttcttttcttttcttttcttttcttttcttttcttttctttttgagacagatttttgctcttgttgcccaggctggagtgcaatggcgcgatcttggctcactgcaacctctgcctcccaggttcaagcaattctcctgcctcagcctcccgagtagctgggagtacaggcatgcaccaccatgcccaactaattttttgtatttagtagagatggagtttcaccatgttagttaggctagtcttgaactcctgacctcaagtgatctgtcaacctcggcttcccaaagtgctgggattacaggcatgagccaccgtgcccggcctccggccatttcttaatatgatccaattacatacctactgataaatatttatcataacttttcctattgtaaacaatgttgcaattaatatctttgggtatccgcaaatttgtgcaaagtgcatgtatttctgtagcaagtttcctagaaatgttaggtcaaagatatgcacatttgaaagttcaacagtcattgtcaaatgccttctaagaagttttctggccaggcactgtggctcacacctgtaatcccaacactatgggaggccaaggtgggtggatcacctgaggtcagaagttcgagaccagcctgaccaacatgatggaaccccatctccactaaaaatacaaaattagccgggtgtgatggcacatgcctgttaatcccagctacttgggaggctgaggcaagagaattgcttgaactcgggaggtggaggtttgcagtgagctgagattgtgccattgctctctaggctgggttgactcctcccccaaaacaaacaaacaaaccaaaaaacaaatgccttctaagaagttttcaccggctgggcacagtggctcatgtttgtaatctcagcactttgggaggctgaggcaagcggatcactggagcccaggagtttgagaccagcctgggcaacatagtgagaccctatctctacaatacaagcaagcaaaaaaaacaaacagaaattagctaggcatggtggcttgtgcctgtaatcccagacaccccgggaggctgaggtgggagaactgcttgagcctgggaggttgagactgcagtaagctgtgacggcaccactgcactccagcctgggcaacagagtgagacgctgtctcaaaaaaaaaaaaaaagttttcaccaacattctttttttgttttgttttgagacagggtctcgctctgttgctctggctggagtacagtggcttgatcatagctcactgcagccttgaacgcgtaagtcctcccgcctcaacctcacaaccagctgggacctacaggcacatactgccatgcttggttaatttttaaattttttgtagagacagggtctcactgttttgcccaggctggtctctagcctcaagcggtcctaccatctcggcctccaaaaagcacttgggattaccagcatgagccactgcacctggccaccaacctacagtcttatcatcactgagttcgtatctacctgcatcctgtccaatactccgtactaccaatctttcaaatttttgtcggctgggcacagtggctcatgcctgtaattccagcactttggaaggccaaggcaggcagactgcttgagcccaggagtttaagaccagcccgggagacatggcaaaaccccatttctgcaaaatatacaaaaattagctgggcttggtggcatgcactggtagtcccagctactccagaggctaagatgggaagatcacctgaccccgggggtttgaggctgtaatgagccaagtcatgctgctgcgctccagcctgggtgacagaacgaggccctgtctcaaaaaaaagaaaaaaaaatttttttttggtcaatataagagtcatagttttgattagcatttcccttattactagtgaagcagaacagcttttcaaatgtttgctgcctgtttgtatctcttcctctgtgacttatctttctccgtgatttgccagtaggcatttgcagtcctttttttcttttttttttgacttggagtctcgcgatctcggctcactacaacctccgcctaccaagttcaagtgattcttgcgcctcagcctcctgagtagctgggattatgagcatgtgccaccacccctagctaattttttgtatttttagtagagatggggttttgccatgttggccaggctggtctcgaactcctgacctcaagtgatccacccgccttggcctcccaaatgctgggattacaggtgtgagccaccacgtccagccgtttgcagtccttccttcacctaactctccagttgccactgttgccagttatagaattttaggtttgaaatggttttctgttggaattctgcagacaatgttccactggctcttagactccatggttgctattgaaaagctggatgccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcaggg

SEQ ID NO: 294 - DNA, 17603 bp, Homo sapiens
cttgggatggacaccattgatatccccaggtctgacataaacaggcaggggggtgctctcagtcctcagatgtgatccctgcctgagctctgttggcattccatggcgaggctcttcagcctcatttgggcagaagcggtcctggggattgcaaaagggctttctttttcttttatttatttctttttagaaacagagtctccttgtgttgcccaggctggagtgcaatggtacaatcatagctcactgcagccttgaactcctgggctcaggcgaccctcccgcctcagccttctttgtaactggaactacaggtgtgcaccaccatgcttagataatttttgtattttttgtgtagagggtgggttctcgctatgttgcccaagctggtctcgaactcctgggctcaagcaatcctcctaccttggcctcccaaagttctgggattacaggcacaagccaccgcgcccggccatttcttttcttttcttttcttttcttttcttttcttttcttttcttttctttttgagacagatttttgctcttgttgcccaggctggagtgcaatggcgcgatcttggctcactgcaacctctgcctcccaggttcaagcaattctcctgcctcagcctcccgagtagctgggagtacaggcatgcaccaccatgcccaactaattttttgtatttagtagagatggagtttcaccatgttagttaggctagtcttgaactcctgacctcaagtgatctgtcaacctcggcttcccaaagtgctgggattacaggcatgagccaccgtgcccggcctccggccatttcttaatatgatccaattacatacctactgataaatatttatcataacttttcctattgtaaacaatgttgcaattaatatctttgggtatccgcaaatttgtgcaaagtgcatgtatttctgtagcaagtttcctagaaatgttaggtcaaagatatgcacatttgaaagttcaacagtcattgtcaaatgccttctaagaagttttctggccaggcactgtggctcacacctgtaatcccaacactatgggaggccaaggtgggtggatcacctgaggtcagaagttcgagaccagcctgaccaacatgatggaaccccatctccactaaaaatacaaaattagccgggtgtgatggcacatgcctgttaatcccagctacttgggaggctgaggcaagagaattgcttgaactcgggaggtggaggtttgcagtgagctgagattgtgccattgctctctaggctgggttgactcctcccccaaaacaaacaaacaaaccaaaaaacaaatgccttctaagaagttttcaccggctgggcacagtggctcatgtttgtaatctcagcactttgggaggctgaggcaagcggatcactggagcccaggagtttgagaccagcctgggcaacatagtgagaccctatctctacaatacaagcaagcaaaaaaaacaaacagaaattagctaggcatggtggcttgtgcctgtaatcccagacaccccgggaggctgaggtgggagaactgcttgagcctgggaggttgagactgcagtaagctgtgacggcaccactgcactccagcctgggcaacagagtgagacgctgtctcaaaaaaaaaaaaaaagttttcaccaacattctttttttgttttgttttgagacagggtctcgctctgttgctctggctggagtacagtggcttgatcatagctcactgcagccttgaacgcgtaagtcctcccgcctcaacctcacaaccagctgggacctacaggcacatactgccatgcttggttaatttttaaattttttgtagagacagggtctcactgttttgcccaggctggtctctagcctcaagcggtcctaccatctcggcctccaaaaagcacttgggattaccagcatgagccactgcacctggccaccaacctacagtcttatcatcactgagttcgtatctacctgcatcctgtccaatactccgtactaccaatctttcaaatttttgtcggctgggcacagtggctcatgcctgtaattccagcactttggaaggccaaggcaggcagactgcttgagcccaggagtttaagaccagcccgggagacatggcaaaaccccatttctgcaaaatatacaaaaattagctgggcttggtggcatgcactggtagtcccagctactccagaggctaagatgggaagatcacctgaccccgggggtttgaggctgtaatgagccaagtcatgctgctgcgctccagcctgggtgacagaacgaggccctgtctcaaaaaaaagaaaaaaaaatttttttttggtcaatataagagtcatagttttgattagcatttcccttattactagtgaagcagaacagcttttcaaatgtttgctgcctgtttgtatctcttcctctgtgacttatctttctccgtgatttgccagtaggcatttgcagtcctttttttcttttttttttgacttggagtctcgcgatctcggctcactacaacctccgcctaccaagttcaagtgattcttgcgcctcagcctcctgagtagctgggattatgagcatgtgccaccacccctagctaattttttgtatttttagtagagatggggttttgccatgttggccaggctggtctcgaactcctgacctcaagtgatccacccgccttggcctcccaaatgctgggattacaggtgtgagccaccacgtccagccgtttgcagtccttccttcacctaactctccagttgccactgttgccagttatagaattttaggtttgaaatggttttctgttggaattctgcagacaatgttccactggctcttagactccatggttgctattgaaaagctggatgccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcagggtctagggaggtctggaatatgtgcgagactattccatgaagtggaaatcatggctgggagggcactttgggaggccgaggcaggcggatcacgaggtcaggagatcgagaccatcctggctaacatggtgaaaccccgtccatactaaaaatacaaaaattagctgcctgtagtcccagctacacgggaggctgaggcaggagaatcgcttgaacccgggaggcggaggttgcagtgagccgagatcgcgccactgcactccggcctggtgacagagcaagactccctctcaaataaaaaagaaagttgtgctggcctggcacagtggcttatgcttgtaatcctagcacgttgggagggtgaggctggtggatcacctgaggtcaggagttcgagaccagcctggccaacatagagaaaccttgtctctactaaaaatacaaaaattagccaggtgtggtggcacacgcctgtaatctcagctactcaagaggctgaggcaggagaatcgcttgaacctgggagacagaagttgcagtgagccaagatagtgccactgcactccagcctgggcaacagagcaatactccatctcaaaaaaaaataatgaataaataaaataaaaaagaagattgtgctttcatttggtggtaatcgtccccagctatgccctctgctcctcatcctcctaggtatagttcaaagtcgtttcccagtccccttaagctcacttctccttccaattcctttcactgcagggagtatccggaaacacactctcttctcaggacaacctgggcccaactggcaggctgtttctgtcaattacacagccgtgggacggatacaggtacagagaagcaaggggtcaggtccttgcacatggtaggcacacccaatgttgaaataaattgaggggcctggtgctgtggctcatgcctgtattcccaatactttgggaggctgaggagggaggatcgcttcaggacaggagttcaagaccagcctgggcaacatagaaagaccccatctctacaaaaaaatacaaaaattaggcgggcacagtgatgtgtgcctgtagtcccagctactagggagcctgaggtgggaggatcacttgagccctggaggtcaaggctgcagtgagctatgatcacaccactgtactccagcctgggcaatagagcaagactctgaaaaaaaaaaaaaaagaaagaaagaactgaattgagggtctgggcacagggagtagggattctgggtcctggaatggagtcgagttagatcaggggcttgggggtgtgggctgtgtgctcactcctgctccatctccctttctctccagtttgccgtggtaggcgtttttggaaagaccccagagccagctgtggcagttgatgcaaccagcattgctccttgtgggggtgagagcaggccctgagaggcccggatctctcagaatccggggtgggctgggggagggctggagagcgtcactcaacttgctca

SEQ ID NO: 295 - DNA, 22107 bp, Homo sapiens
atggaacaaatgaactctacttccactcttgatttctacttctcattttcccctttactctgaccacaacttcagattccttctcaaaaataatgcttcagcgggaaaggaccactgaggagggacctgtgcagacagcaaaagctgtcataaaactgtatgggaggccaggcacggtggctcatgcctgtaatcccagcactttgggaggctgaggtgggtggatcatctgaggtcaggtgtttgagaccagcctggccaacgtggtgaaaccccatgtctactaaaaatacaaaaaattagccgggtgtggtggtgggctcctgtaatcccagctattctggaggctgaggcaggagaatcactgaacctgggaggcggaggttgcagtgagccgaggtcgtgccactggactccagcctgggcgacaagagcgaaactctgtctcaaaaacaaaacaaaaacaaacaaacaaaaacaactgtatgggaccccgatcctggttgttatcccatatgtgagggccggtctttctgcttgtatcatcaactgtagagaagtcagcctgtgttcccctgcacatatgcaaacgggagagaatgttttgcaatccgcagcaggaaaaattacgggaaggttttggaggttggagggtacttgacaggtgtgtagggagcggggcggtaggtgtggagctgggatgcgaggagtcgccaaaggggaggacccaagagaattttccctctgttctaaccggctcgtgggctacagtgccctcttcaggtcttactaggaactgctagagaaacctacaagcgatagatccttagggctctgaccttgtacatttcttttcttttcttttcttttcttttttttcaatggagtctcactctgtcactcaggctggagtgcagtggcgcgatctcggctcactgcaacctccgcctcccgggttcaagcgattctcctgcctcagcctcccgagtagctgggactacagacgcctgctaacacacctggctaattttttgtatttttagtagagatggagtttcaccaggtcgaccaggctggtctcaaactcctgagctcagaggatccgcccacctcggcctcccaaagtgttgggtttacaggcgtgagccaccgcgcccggctgtgaccttgtacatttcaatacacatttatattgtggtttccacagatggcatttgattcttgcaccaggaatgctgtgagtcagtaaaggagaaatctccctcttaggctgctgacatcggagctaagaggcttgttcttaagccgaaggaatctggctaataagagactgagctagaacctgagcacaggatttaggactcctaatcccaaaggctgtccacctcttagcctgatttgtagtctaaggctcaaacatctcatcaatgagcaacccgcttttgcctccctcctctccgtctgcaggattcagggtcactgatcttattccacaactgtcttcagacttctcactgctttcagtttctaaaatataataaaaaaatagtaattttcaaccagatgttgtggctcacgcctgtaatcccagcactttgggaggctgaggtgggaggatcccttgagctcaggagtttgagaccaccctgggcaacatagtgagacccccatctctacaaaaaaatttaaacattagctggatgtggtggcatgcagctgtagtgccagctactcaggaggctgaggtgggagaatcactcaagcctgggaggttgaggctgcagtgagctgtgatcacaccactgcattctagcctgggtgacagagcaagatcccatcccctcccccacaaaaagagtagttatcaaacctgaactgtctgaccactcctgggatggatgtgagaggcaagtacgttagaaacatttaaaacatttattccaagtttatagaatggctactgtgaaccaagcctttgcactaagtgctaggagacatgaaatgacactcatagcccagtggccagtgggcagcctcctgggggcaaaaaaaggcacacattaattcattttattttatttatttattttttgagacagggtcttgttgtgtcacccaggctggagggcagtggcacaatctcagctcactgcaacctccacctcctgggttcaagcaattcttgtgcctcagcctcccgagtagctgggattacaggcacatgccaccacacccggctagtttgtgtgtgtgtgtttgtgtttttttgtttgtttgtttttgttttgttttttggtagagatggggtttctccatgttggccagcctggtctcgaactcctgatctcaggtgatccactcatcagtctcccaaaatgctgggattacatgcatgagccactgcacctggccttgacgcacattaattcagacgtagtcattttggtatgggactgagtgctaagctgtgcaatgccaagaggccggggaagggaagaaccacaggatttagaagaactaagcgaggcccagagtctgtgctgagaggcagattcccaaggagggtgttgccagatttcagaggttcttcgagtgcaggccaggaaaggaactttcctctgaactgtgatcatggttataattaacaacacattcaatctgtggcatctgcatgctgcgattctcacccgaactccacgaagcaggaatacaatgagtatcatccccatttgtcagatggggaactaagttctgctggaaagtgacagagccaacacttttgactttctggtggggacaggagccagcaaagcctagttctgagtcaaggggttacataattgtttaaagatgatgccttctgtttgtagagagcttggctatttacatgaaaagcatgtgatttcctggcatgcttttcatttgctctcctaacgccaagaggaaggcagggatgatggagggtccccattttgcagaggaggaaactgaggcccaaagagattatgggccttgcccaggtcataaaacacggagatggggctggacgaagtggctcatactagtaatcccagcactttgggagactgaggcaggaggagggcttgagcacaagagttccagactggccccagaaacatagggagaccctgtctctaaaaaaaattttaaagcagtggggcatgatggtgtgcacctgtaggcccagcagaagcaggagggatcacttgaacccagggatttgagactgcattgagctatgattgcagcgctgcactccagccagggtgacagagcaagaccctggctcaaaagagagaaaaaaaaaaagtccgggtgtggtagctcaagtctgtaatccctgcactttgggaggccaaggtgggtggatcacttgaggtcaggaatttgagaccagcctggccaacatggtgaaaccccatctctactaaaattacaaacattagccaggtgtggtggtgcatgcctgtaatcccagctacttgggaggcagaggcacgaggattgcttgaacctgggaggcagaggttgcagtgagctgagagatcgagtcactgcactccatcttgagcaacaagagcgagactccgtctcaaaaagaaaaaaaaaagagagagagagagagtcccttttctctctgacccaggatcaccagggagaggaaagagaagagatggagtgaatgagacagctgtggtcagcaaggcgtgtccatcttccacgaccgactccttcccattcaatcccctgccttgggatcctgcttcttccctgcataggcagaaagtacctaccaacttcccttcttcccaactccctgctctgagtactgcgctaggagccaactcagccacctcctgcagccccagctctccatcttaactgcagcctctcgctcttgggtactcactgactcaaatcctccctctgggcccaagcatcaggctgaacaaagacctgtccctagttcacaggtcacctaggattctttttttttttctttgagatggggtttcgctcttgttgcccaggctggagtgcaatggcgcgatctcagctcactgcaaactttgcctcccgggttcaaatgattctcctgcctcagcctcctgagtagctgggattacaggcatgtgccaccacacctggttaattttgtatttttagtacagacagggtttctccgtgttggtcaggctggtctcgaaccccgacctcaggtgatccacctgcctcaacctcccaaagtgctgggattacaggcgtgagccactgtgcctggccagtcacctagggttctgctggaactactgaactgtagttcagtaggtgatcttaccacagtagggtttgttgctggagttgcattagctaaacagggtcttttagacactggaatctaagctgaaggctaataatattatttgaagatggtgaaagttaattctactaaaattccatcataaaactgtggcattgtgaaggattgttggcaacaaataaatagacgatagtatagtttctcaatttatgggagtcatggccaaatgtctctaaactcccttctttatttaagaaaattgattattaaaaatggccagtggttcacgcctgtaatcccaacactttggggggccaaggtgggcggatcacctgaggtcaggagttcgagaccagcctgaccaacatggtgaaatcccgtctctactaaaaataaaaaattagctgggtgtggtggtgcatgcctgtaatcccagctagttggaaggttgaggcaggagaattgcttgaacctgggaggcggaggttgcagtgagccaagatcgtaccattgcactccagcctgggcaacaagggcaaaacaagataaaaaaaaaattacgtgaccgggcgcggtgatgtacacttgtaataccagcactgtgggaggccaaggtgagaggatcacttgaggctggtagtttgagaccagcctagtcaacatagtgagatccctgtttctataaaaaatttgctgggctactaaaaaatagactgtagttccaactacttgggaggctgaggttgtagtgagctatgattgagccactgaactctaacctgggtgatagagcaagacactgtctcaaaaaaaaaagtgactgccacacataaatttctttcttttattattattattattattattttttgagacagagtctcactctgtcacccaggctggagtgcagtggtgcgatctcggctcactgcaacctacccctcctgggttcaagagattctcctgcctcagcctcctgagtagctgggactacaggtgcgcaccaccatgcccagctaattttgtatttttagtacatacggggtttcaccatgttggccaggctgatcttgaactcctggcctcaggtgatctgcccaccttggcctcccaaagtgttgggattataggtgtgagccactgcacccagccaacatcatagatttctggctttaaaaaaatcttggctgtactgattgagcctcctccccaatcttacagaggaaggaactaagacacagagagggtgagaaaagttcccaaagacacacagcaaatttaggactgggctccagttctctcaagggcttttccacagcccaaggtctctcacacctgttcccacagctgccagtcttgtcaaggttgccagtctctggggcgttgctggttcctggctccctaaaatacagggcccaagggtcctcccccactttcctgtcctgccgtgagccccccacccccacttccagacggattgggagctgtgacccccagctctgtggtcccaaagggaggtcagctaaagcagctaccaggggacttattgcccaacagggagtggctatgatcaatgtcttctgctcctcttccctgggttaaccatttcctggccctggcccctctgttaattcctctgctaacctggtatggaggaagggtggacaagggcttgggatggacaccattgatatccccaggtctgacataaacaggcaggggggtgctctcagtcctcagatgtgatccctgcctgagctctgttggcattccatggcgaggctcttcagcctcatttgggcagaagcggtcctggggattgcaaaagggctttctttttcttttatttatttctttttagaaacagagtctccttgtgttgcccaggctggagtgcaatggtacaatcatagctcactgcagccttgaactcctgggctcaggcgaccctcccgcctcagccttctttgtaactggaactacaggtgtgcaccaccatgcttagataatttttgtattttttgtgtagagggtgggttctcgctatgttgcccaagctggtctcgaactcctgggctcaagcaatcctcctaccttggcctcccaaagttctgggattacaggcacaagccaccgcgcccggccatttcttttcttttcttttcttttcttttcttttcttttcttttcttttctttttgagacagatttttgctcttgttgcccaggctggagtgcaatggcgcgatcttggctcactgcaacctctgcctcccaggttcaagcaattctcctgcctcagcctcccgagtagctgggagtacaggcatgcaccaccatgcccaactaattttttgtatttagtagagatggagtttcaccatgttagttaggctagtcttgaactcctgacctcaagtgatctgtcaacctcggcttcccaaagtgctgggattacaggcatgagccaccgtgcccggcctccggccatttcttaatatgatccaattacatacctactgataaatatttatcataacttttcctattgtaaacaatgttgcaattaatatctttgggtatccgcaaatttgtgcaaagtgcatgtatttctgtagcaagtttcctagaaatgttaggtcaaagatatgcacatttgaaagttcaacagtcattgtcaaatgccttctaagaagttttctggccaggcactgtggctcacacctgtaatcccaacactatgggaggccaaggtgggtggatcacctgaggtcagaagttcgagaccagcctgaccaacatgatggaaccccatctccactaaaaatacaaaattagccgggtgtgatggcacatgcctgttaatcccagctacttgggaggctgaggcaagagaattgcttgaactcgggaggtggaggtttgcagtgagctgagattgtgccattgctctctaggctgggttgactcctcccccaaaacaaacaaacaaaccaaaaaacaaatgccttctaagaagttttcaccggctgggcacagtggctcatgtttgtaatctcagcactttgggaggctgaggcaagcggatcactggagcccaggagtttgagaccagcctgggcaacatagtgagaccctatctctacaatacaagcaagcaaaaaaaacaaacagaaattagctaggcatggtggcttgtgcctgtaatcccagacaccccgggaggctgaggtgggagaactgcttgagcctgggaggttgagactgcagtaagctgtgacggcaccactgcactccagcctgggcaacagagtgagacgctgtctcaaaaaaaaaaaaaaagttttcaccaacattctttttttgttttgttttgagacagggtctcgctctgttgctctggctggagtacagtggcttgatcatagctcactgcagccttgaacgcgtaagtcctcccgcctcaacctcacaaccagctgggacctacaggcacatactgccatgcttggttaatttttaaattttttgtagagacagggtctcactgttttgcccaggctggtctctagcctcaagcggtcctaccatctcggcctccaaaaagcacttgggattaccagcatgagccactgcacctggccaccaacctacagtcttatcatcactgagttcgtatctacctgcatcctgtccaatactccgtactaccaatctttcaaatttttgtcggctgggcacagtggctcatgcctgtaattccagcactttggaaggccaaggcaggcagactgcttgagcccaggagtttaagaccagcccgggagacatggcaaaaccccatttctgcaaaatatacaaaaattagctgggcttggtggcatgcactggtagtcccagctactccagaggctaagatgggaagatcacctgaccccgggggtttgaggctgtaatgagccaagtcatgctgctgcgctccagcctgggtgacagaacgaggccctgtctcaaaaaaaagaaaaaaaaatttttttttggtcaatataagagtcatagttttgattagcatttcccttattactagtgaagcagaacagcttttcaaatgtttgctgcctgtttgtatctcttcctctgtgacttatctttctccgtgatttgccagtaggcatttgcagtcctttttttcttttttttttgacttggagtctcgcgatctcggctcactacaacctccgcctaccaagttcaagtgattcttgcgcctcagcctcctgagtagctgggattatgagcatgtgccaccacccctagctaattttttgtatttttagtagagatggggttttgccatgttggccaggctggtctcgaactcctgacctcaagtgatccacccgccttggcctcccaaatgctgggattacaggtgtgagccaccacgtccagccgtttgcagtccttccttcacctaactctccagttgccactgttgccagttatagaattttaggtttgaaatggttttctgttggaattctgcagacaatgttccactggctcttagactccatggttgctattgaaaagctggatgccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcaggg

SEQ ID NO: 296 - DNA, 14471 bp, Homo sapiens
cccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttaaatagctaactaaacaaaatgctaacccatatgggagaaatttccaaagaattaaaaccacccaccaggaaaatgggaaagtctcccctccacacacacacacacgcacacacacacacacacacacacatacacacacacacacacacacacaaaatcaccaaatcacacctgaacaagaggaagaaaattaaactcattgaggagataccatctttttttaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttgtggggtggggcctgcagtctgaggtttattttttctaaaactttaagttccagggtacatgtgtaagatgtgcaagtttgttacataggtaatcatctgccacggtggtttgctgcagagatcaacttatcacctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgactgcagcagttttcacagtagaaaagacatggaattcacccaatccgaattttaacaagtcttccatgtgattctgagacagactcatgttcgtgtggttctggctctgcagaactgaggtgggccccaaaacttgcgtttctaaaaggtactagctgagcatgatgactcacatttgtaatcccaccactttgtgaggccgaggcgggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaagcctacagttgacaggcagataacagagggagcaaaggagtcttgtggaagacaatagggagtgttgaggacctgtcaaacaacacagtccccatctgtactttgggaggtaaggacttcttagttccagctgcctgttgccatgggggaacatagacccagagctgccatcttttctaatttttttaaaaattagaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctgagtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtagctggtaactcataaatttttaaacactctgcagttcaaagaaaacatgtttgtggtaggtagccagtttataacctgtgtaagactgtgttattagcaaatccctcaatgtgttgaccaagagtgggtaggaatcctgcagacagaatcttttgaaggtggtttgtttttttattcctttataagtacagttgtagatttacaaagtaattgagtatatagtacataaggtcttgtgtacccaccgatcgcaattgagcatatagtacatgctgtcctgtgtacccactgatccctggtcctgcccctggtatgagggtattaacatcttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacctcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacaccaacaccctcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagaaattctgtagtttccacaagtaaccagagaattgttcaaggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaagttagtcaggtatgtctattaaatttttacgtaaaaagttaaagcagccctcagcatcaacttcttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttttttttgtttaaattgttataaataagtaagtgtatgcaccactatgccatgtagcatatcaagattatttttctttcctgcaccttattttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgcagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggatttggtgggggggggggggacgtttctatttcctttatgtttgataacattctattcttgtttcatggatgatgttactcttttaactctctgatgttaatgataattgttttaatttttcttttctgtttagtttctatcttctcaaaattgttttcatttcttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcaaccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaatttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttggaggggacctttctggggtcttttagtcagggtacataagtgtcagctgctacgacaaacaacttgcaacgtctcattatcttcatacaacaaacgctgatttgttcctttcattacatatccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagcccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactatcattctgccatcaacaccgaggtgtcggagtagcaggagagccacatatttcttagtgaggggacccagaatgatcccttttgtgctagaggatctgagttcatttcatgaaactgaagcatcttcttggagatataagctcaccttgggataggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgacaccatgactctgctttctgggtgtcctctgtgggctctcagcagtgtccccgatgtggagggtcttcttattctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaccatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgctctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcgggcaggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattgtcctggatgtcgttttctcataaagttgactatggctattggtggtactagtatgactgtcaagtcgatcaggtggctgaggagcagtacatgggggtatacagagtgcaggcctcagaactgcagaacatctgcacaatctccagcaagctaacctctctggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaaaaaaaaaaaaaaaaaaaaaaaaaaaaaaaaaaattttagtcgggtgtaatggcacacctgtagtcccatctactcgggaggctgaggtgggaagtttgaacctgggaagtcaaggctacagtgagctgtgatcctgtctctacacctcagtctgggtggcagagcaagaccctgtctcaaaaaaaaaaaaaaaaaaaaaaaagtaaaataaagcatgggaagtcccttatacagtttgtgatatgggtacacactcagtgaaatggccattaatactgctgttcttaactctgaaagcagagtgggccatttgaatgctcactttgatattttttaaaggaaaaatttgaggcattgacacatgccttttgcttacttgcttggattggtttgatcaactttgttgcggtctaatttatgtaaaataaattgcatccatttaaatatacaattcaatgagttttgacagatgcacatgcccatgaaaccaacacgaaaataaaaaaaatagaacatttacatcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggagtggaatgggcagggtggtccgtatagggctatgtataactttttaagaggttggcaaatacttccctaaagtggtcatcccattttacattcttgccaacagtgtttaaggatccacttcctctacatccttaataatacttgatattattggtcttctaaattttctgtttgggtacatagtggtattttgttgtatatttttttttaattgtgaaatatgtgagtatgatgagtaatgattttgaacatgaaaactatgcttattgctcatatctatgttattttattatttactttttttgagatggagtctcgctctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgcgtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtctagttccaagtatctgtccatggtgttggtcccaggttattcgcacctcatatgtctttggcacagcactcttgacagctcataaagtcacgctgttacccccacaatgtccccccacatatcattgctatccctcctcgacacccacacctcttgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttgtacatatcttaaaagtggattcctcataaaacaatatggactatggtcttattctgtttaacggtatgaaggctcgcctgaaaggccaagagtaagattcttttaaaatcatgcccaagttttaaaggaatataaaactttctctttaaaaatatacctttctgcttccatcccctaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagcccagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggagaaaaaagatcatagagccaaagagctcgatacatatactgatgcggtgtttattttattttagttttttgagacagggtctctgtcgctcaggctggattgagtgcagtgaatcttggctcactgtagcttttgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaatacaa

SEQ ID NO: 297 - DNA, 16932 bp, Homo sapiens
cccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttaaatagctaactaaacaaaatgctaacccatatgggagaaatttccaaagaattaaaaccacccaccaggaaaatgggaaagtctcccctccacacacacacacacgcacacacacacacacacacacacatacacacacacacacacacacacaaaatcaccaaatcacacctgaacaagaggaagaaaattaaactcattgaggagataccatctttttttaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttgtggggtggggcctgcagtctgaggtttattttttctaaaactttaagttccagggtacatgtgtaagatgtgcaagtttgttacataggtaatcatctgccacggtggtttgctgcagagatcaacttatcacctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgactgcagcagttttcacagtagaaaagacatggaattcacccaatccgaattttaacaagtcttccatgtgattctgagacagactcatgttcgtgtggttctggctctgcagaactgaggtgggccccaaaacttgcgtttctaaaaggtactagctgagcatgatgactcacatttgtaatcccaccactttgtgaggccgaggcgggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaagcctacagttgacaggcagataacagagggagcaaaggagtcttgtggaagacaatagggagtgttgaggacctgtcaaacaacacagtccccatctgtactttgggaggtaaggacttcttagttccagctgcctgttgccatgggggaacatagacccagagctgccatcttttctaatttttttaaaaattagaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctgagtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtagctggtaactcataaatttttaaacactctgcagttcaaagaaaacatgtttgtggtaggtagccagtttataacctgtgtaagactgtgttattagcaaatccctcaatgtgttgaccaagagtgggtaggaatcctgcagacagaatcttttgaaggtggtttgtttttttattcctttataagtacagttgtagatttacaaagtaattgagtatatagtacataaggtcttgtgtacccaccgatcgcaattgagcatatagtacatgctgtcctgtgtacccactgatccctggtcctgcccctggtatgagggtattaacatcttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacctcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacaccaacaccctcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagaaattctgtagtttccacaagtaaccagagaattgttcaaggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaagttagtcaggtatgtctattaaatttttacgtaaaaagttaaagcagccctcagcatcaacttcttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttttttttgtttaaattgttataaataagtaagtgtatgcaccactatgccatgtagcatatcaagattatttttctttcctgcaccttattttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgcagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggatttggtgggggggggggggacgtttctatttcctttatgtttgataacattctattcttgtttcatggatgatgttactcttttaactctctgatgttaatgataattgttttaatttttcttttctgtttagtttctatcttctcaaaattgttttcatttcttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcaaccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaatttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttggaggggacctttctggggtcttttagtcagggtacataagtgtcagctgctacgacaaacaacttgcaacgtctcattatcttcatacaacaaacgctgatttgttcctttcattacatatccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagcccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactatcattctgccatcaacaccgaggtgtcggagtagcaggagagccacatatttcttagtgaggggacccagaatgatcccttttgtgctagaggatctgagttcatttcatgaaactgaagcatcttcttggagatataagctcaccttgggataggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgacaccatgactctgctttctgggtgtcctctgtgggctctcagcagtgtccccgatgtggagggtcttcttattctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaccatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgctctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcgggcaggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattgtcctggatgtcgttttctcataaagttgactatggctattggtggtactagtatgactgtcaagtcgatcaggtggctgaggagcagtacatgggggtatacagagtgcaggcctcagaactgcagaacatctgcacaatctccagcaagctaacctctctggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaaaaaaaaaaaaaaaaaaaaaaaaaaaaaaaaaaattttagtcgggtgtaatggcacacctgtagtcccatctactcgggaggctgaggtgggaagtttgaacctgggaagtcaaggctacagtgagctgtgatcctgtctctacacctcagtctgggtggcagagcaagaccctgtctcaaaaaaaaaaaaaaaaaaaaaaaagtaaaataaagcatgggaagtcccttatacagtttgtgatatgggtacacactcagtgaaatggccattaatactgctgttcttaactctgaaagcagagtgggccatttgaatgctcactttgatattttttaaaggaaaaatttgaggcattgacacatgccttttgcttacttgcttggattggtttgatcaactttgttgcggtctaatttatgtaaaataaattgcatccatttaaatatacaattcaatgagttttgacagatgcacatgcccatgaaaccaacacgaaaataaaaaaaatagaacatttacatcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggagtggaatgggcagggtggtccgtatagggctatgtataactttttaagaggttggcaaatacttccctaaagtggtcatcccattttacattcttgccaacagtgtttaaggatccacttcctctacatccttaataatacttgatattattggtcttctaaattttctgtttgggtacatagtggtattttgttgtatatttttttttaattgtgaaatatgtgagtatgatgagtaatgattttgaacatgaaaactatgcttattgctcatatctatgttattttattatttactttttttgagatggagtctcgctctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgcgtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtctagttccaagtatctgtccatggtgttggtcccaggttattcgcacctcatatgtctttggcacagcactcttgacagctcataaagtcacgctgttacccccacaatgtccccccacatatcattgctatccctcctcgacacccacacctcttgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttgtacatatcttaaaagtggattcctcataaaacaatatggactatggtcttattctgtttaacggtatgaaggctcgcctgaaaggccaagagtaagattcttttaaaatcatgcccaagttttaaaggaatataaaactttctctttaaaaatatacctttctgcttccatcccctaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagcccagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggagaaaaaagatcatagagccaaagagctcgatacatatactgatgcggtgtttattttattttagttttttgagacagggtctctgtcgctcaggctggattgagtgcagtgaatcttggctcactgtagcttttgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaatacaagagaaatataagagaaagaaagacttgtatctgttgttagtgagtttttgtggtggtgatacattaatggaggcaacagagggtcagaaatcagggtggaaaatagcccagcagaggggaaaagaggaagtctgaacgagggccacattgcagatagaggccggtgtactggtctgctcaggctgccataacaaaataccacaggctggataacttgaacaacaaaaatacattttctcatagttgtggagcctagaattccaaggtcaaggttccggcacagttgatgtcttctgaggtctacctcgtctgcttgcagacagccgccttcccaccgtgttctcacgtgacctagccgctgtgtgcacgcatccctggtttcttttcctgtgttcagatgtcctcttctttgaaggacaccactcagattgcaataggacctgccctgatagcctcattttttacataatcacctctttataggccgtacctccaaatacagtcacattctgaggtagtacgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccgtttatccatggattggtatgagccctaatggtgcacccttccgacaatccttcatccttcccagacgtttcatcagccaggtgaaatttgcaattgtttcagtgattgaaattatgcttggagtgcaggtgtcaccgatgaaacagcaatgccttgcggtgacaaattcagtgtagaaataattttagcaagcccagtgattggaaaacaatgactcaactttgagctatattgattttgtatttctgggctcagcttttgactcagtctcattccccagaaataatccctgttaacatttcggtttgtgttatggaagtgttctctcttctatgaattacctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaagtgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctcgatccttacacttagcatcatgttttcaagggtcattcatgttgtagcatgtatcagtacttctttttttagggctgagtaatattccatttacggatatgccacatttcatctatgcattcagttcacggacatgtaggttgtttccacattttggctattgtgcataatgcttccaggtacacttgtctacacatttttgtgtggatataggtttaccttttttggggtatgctcctaagagtgcaatttctggatcacgtggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcactttt

SEQ ID NO: 298 - DNA, 18914 bp, Homo sapiens
cccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttaaatagctaactaaacaaaatgctaacccatatgggagaaatttccaaagaattaaaaccacccaccaggaaaatgggaaagtctcccctccacacacacacacacgcacacacacacacacacacacacatacacacacacacacacacacacaaaatcaccaaatcacacctgaacaagaggaagaaaattaaactcattgaggagataccatctttttttaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttgtggggtggggcctgcagtctgaggtttattttttctaaaactttaagttccagggtacatgtgtaagatgtgcaagtttgttacataggtaatcatctgccacggtggtttgctgcagagatcaacttatcacctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgactgcagcagttttcacagtagaaaagacatggaattcacccaatccgaattttaacaagtcttccatgtgattctgagacagactcatgttcgtgtggttctggctctgcagaactgaggtgggccccaaaacttgcgtttctaaaaggtactagctgagcatgatgactcacatttgtaatcccaccactttgtgaggccgaggcgggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaagcctacagttgacaggcagataacagagggagcaaaggagtcttgtggaagacaatagggagtgttgaggacctgtcaaacaacacagtccccatctgtactttgggaggtaaggacttcttagttccagctgcctgttgccatgggggaacatagacccagagctgccatcttttctaatttttttaaaaattagaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctgagtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtagctggtaactcataaatttttaaacactctgcagttcaaagaaaacatgtttgtggtaggtagccagtttataacctgtgtaagactgtgttattagcaaatccctcaatgtgttgaccaagagtgggtaggaatcctgcagacagaatcttttgaaggtggtttgtttttttattcctttataagtacagttgtagatttacaaagtaattgagtatatagtacataaggtcttgtgtacccaccgatcgcaattgagcatatagtacatgctgtcctgtgtacccactgatccctggtcctgcccctggtatgagggtattaacatcttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacctcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacaccaacaccctcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagaaattctgtagtttccacaagtaaccagagaattgttcaaggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaagttagtcaggtatgtctattaaatttttacgtaaaaagttaaagcagccctcagcatcaacttcttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttttttttgtttaaattgttataaataagtaagtgtatgcaccactatgccatgtagcatatcaagattatttttctttcctgcaccttattttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgcagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggatttggtgggggggggggggacgtttctatttcctttatgtttgataacattctattcttgtttcatggatgatgttactcttttaactctctgatgttaatgataattgttttaatttttcttttctgtttagtttctatcttctcaaaattgttttcatttcttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcaaccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaatttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttggaggggacctttctggggtcttttagtcagggtacataagtgtcagctgctacgacaaacaacttgcaacgtctcattatcttcatacaacaaacgctgatttgttcctttcattacatatccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagcccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactatcattctgccatcaacaccgaggtgtcggagtagcaggagagccacatatttcttagtgaggggacccagaatgatcccttttgtgctagaggatctgagttcatttcatgaaactgaagcatcttcttggagatataagctcaccttgggataggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgacaccatgactctgctttctgggtgtcctctgtgggctctcagcagtgtccccgatgtggagggtcttcttattctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaccatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgctctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcgggcaggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattgtcctggatgtcgttttctcataaagttgactatggctattggtggtactagtatgactgtcaagtcgatcaggtggctgaggagcagtacatgggggtatacagagtgcaggcctcagaactgcagaacatctgcacaatctccagcaagctaacctctctggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaaaaaaaaaaaaaaaaaaaaaaaaaaaaaaaaaaattttagtcgggtgtaatggcacacctgtagtcccatctactcgggaggctgaggtgggaagtttgaacctgggaagtcaaggctacagtgagctgtgatcctgtctctacacctcagtctgggtggcagagcaagaccctgtctcaaaaaaaaaaaaaaaaaaaaaaaagtaaaataaagcatgggaagtcccttatacagtttgtgatatgggtacacactcagtgaaatggccattaatactgctgttcttaactctgaaagcagagtgggccatttgaatgctcactttgatattttttaaaggaaaaatttgaggcattgacacatgccttttgcttacttgcttggattggtttgatcaactttgttgcggtctaatttatgtaaaataaattgcatccatttaaatatacaattcaatgagttttgacagatgcacatgcccatgaaaccaacacgaaaataaaaaaaatagaacatttacatcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggagtggaatgggcagggtggtccgtatagggctatgtataactttttaagaggttggcaaatacttccctaaagtggtcatcccattttacattcttgccaacagtgtttaaggatccacttcctctacatccttaataatacttgatattattggtcttctaaattttctgtttgggtacatagtggtattttgttgtatatttttttttaattgtgaaatatgtgagtatgatgagtaatgattttgaacatgaaaactatgcttattgctcatatctatgttattttattatttactttttttgagatggagtctcgctctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgcgtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtctagttccaagtatctgtccatggtgttggtcccaggttattcgcacctcatatgtctttggcacagcactcttgacagctcataaagtcacgctgttacccccacaatgtccccccacatatcattgctatccctcctcgacacccacacctcttgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttgtacatatcttaaaagtggattcctcataaaacaatatggactatggtcttattctgtttaacggtatgaaggctcgcctgaaaggccaagagtaagattcttttaaaatcatgcccaagttttaaaggaatataaaactttctctttaaaaatatacctttctgcttccatcccctaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagcccagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggagaaaaaagatcatagagccaaagagctcgatacatatactgatgcggtgtttattttattttagttttttgagacagggtctctgtcgctcaggctggattgagtgcagtgaatcttggctcactgtagcttttgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaatacaagagaaatataagagaaagaaagacttgtatctgttgttagtgagtttttgtggtggtgatacattaatggaggcaacagagggtcagaaatcagggtggaaaatagcccagcagaggggaaaagaggaagtctgaacgagggccacattgcagatagaggccggtgtactggtctgctcaggctgccataacaaaataccacaggctggataacttgaacaacaaaaatacattttctcatagttgtggagcctagaattccaaggtcaaggttccggcacagttgatgtcttctgaggtctacctcgtctgcttgcagacagccgccttcccaccgtgttctcacgtgacctagccgctgtgtgcacgcatccctggtttcttttcctgtgttcagatgtcctcttctttgaaggacaccactcagattgcaataggacctgccctgatagcctcattttttacataatcacctctttataggccgtacctccaaatacagtcacattctgaggtagtacgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccgtttatccatggattggtatgagccctaatggtgcacccttccgacaatccttcatccttcccagacgtttcatcagccaggtgaaatttgcaattgtttcagtgattgaaattatgcttggagtgcaggtgtcaccgatgaaacagcaatgccttgcggtgacaaattcagtgtagaaataattttagcaagcccagtgattggaaaacaatgactcaactttgagctatattgattttgtatttctgggctcagcttttgactcagtctcattccccagaaataatccctgttaacatttcggtttgtgttatggaagtgttctctcttctatgaattacctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaagtgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctcgatccttacacttagcatcatgttttcaagggtcattcatgttgtagcatgtatcagtacttctttttttagggctgagtaatattccatttacggatatgccacatttcatctatgcattcagttcacggacatgtaggttgtttccacattttggctattgtgcataatgcttccaggtacacttgtctacacatttttgtgtggatataggtttaccttttttggggtatgctcctaagagtgcaatttctggatcacgtggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattccgcagaaaaaagtactgattgtccagcagttgtgtcaggtagaaaactgggatgcccgactgcattggtttagccagaactatggccatgaaaccttgcctggcccccagggatggggtgaggggggatatcatatacgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcgtggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgtatcaccaggcccagctaatttttatatttttactcgagacgtagtttcaccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcggcctatgcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcaatgttagtgacttagaaccacacaaaagttacactttacagttttggaggtcagtggtccaaaataggtctcagtgggctaaaatcgatgtgtcagcaggacaccatttctttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctgcttctgcttttaaggaaccttgtaacttcagggagtctaccctgataatctgggataatctgcctgtttgaaggtcagccaattagcaatcttaatgccatctacaaccttaattaccatttgctatgtaacatatttatagatatcagggattagttcatgaacatattggggtagagggcattccacatacagcagtacctataatgtatatgcttcttaaagaatgcatgagtcttaaatttattttatgtccttggagtgtatagcagagttagatagatccttctggattggcggttgattgaatattggctgtacaaagaaactggataggagtatagagaaaagatcaatcatagcactagcttatagtttattttattctttaatgattttttaaaaatatttctctcacttacttgaaaagcagtcttagaaattaactggaatgggtaatttattcgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaa
